US011472885B2

(12) United States Patent
DeFalco et al.

(10) Patent No.: US 11,472,885 B2
(45) Date of Patent: Oct. 18, 2022

(54) ANTIBODIES THAT BIND TUMOR TISSUE FOR DIAGNOSIS AND THERAPY

(71) Applicant: Atreca, Inc., S. San Francisco, CA (US)

(72) Inventors: Jeff DeFalco, Fremont, CA (US); Daniel Eric Emerling, El Cerrito, CA (US); Jessica Finn, Redwood City, CA (US); Norman Michael Greenberg, North Potomac, MD (US); Vera Huang, El Cerrito, CA (US); Shaun M. Lippow, San Carlos, CA (US); Fengling Liu, San Carlos, CA (US); Amy Manning-Bog, Fremont, CA (US); William H. Robinson, Palo Alto, CA (US); Alexander Scholz, Emerald Hills, CA (US); Tito Serafini, Belmont, CA (US); Yann Chong Tan, Singapore (SG); Nikhil Vad, Foster City, CA (US); Wayne Volkmuth, Foster City, CA (US)

(73) Assignee: Atreca, Inc., San Carlos, CA (US)

( * ) Notice: Subject to any disclaimer, the term of this patent is extended or adjusted under 35 U.S.C. 154(b) by 145 days.

(21) Appl. No.: 16/792,115

(22) Filed: Feb. 14, 2020

(65) Prior Publication Data

US 2020/0325242 A1 Oct. 15, 2020

Related U.S. Application Data

(60) Provisional application No. 62/927,501, filed on Oct. 29, 2019, provisional application No. 62/852,830, filed on May 24, 2019, provisional application No. 62/843,751, filed on May 6, 2019, provisional application No. 62/843,298, filed on May 3, 2019, provisional application No. 62/806,285, filed on Feb. 15, 2019, provisional application No. 62/806,310, filed on Feb. 15, 2019.

(51) Int. Cl.

| | |
|---|---|
| ***C07K 16/30*** | (2006.01) |
| ***A61P 35/00*** | (2006.01) |
| ***A61K 39/395*** | (2006.01) |
| ***A61K 39/00*** | (2006.01) |
| ***G01N 33/68*** | (2006.01) |

(52) U.S. Cl.

CPC .......... *C07K 16/30* (2013.01); *A61K 39/3955* (2013.01); *A61K 39/39558* (2013.01); *A61P 35/00* (2018.01); *G01N 33/6854* (2013.01); *A61K 2039/507* (2013.01); *C07K 2317/565* (2013.01)

(58) Field of Classification Search

CPC combination set(s) only.
See application file for complete search history.

(56) References Cited

U.S. PATENT DOCUMENTS

2018/0100864 A1 4/2018 Defalco et al.

FOREIGN PATENT DOCUMENTS

WO WO-2005040810 A1 * 5/2005 ....... G01N 33/57415

OTHER PUBLICATIONS

Zhang et al 2015 (PABPC1 interacts with AGO2 and is responsible for the microRNA mediated gene silencing in high grade hepatocellular carcinoma, Cancer Letters, vol. 367, Oct. 2015). (Year: 2015).*

Baia et al., "Mining The Cancer Immuno-Responsome: The Identification of Functional Antitumor Antibodies From Patients Receiving Checkpoint Inhibitors", Cancer Research, vol. 78, No. 13, Jul. 2018, 3 pages.

Defalco et al., "Non-Progressing Cancer Patients Have Persistent B Cell Responses Expressing Shared Antibody Paratopes that Target Public Tumor Antigens", Clinical Immunology, vol. 187, Feb. 2018, pp. 37-45.

PCT/US2020/018350—International Preliminary Report on Patentability, dated Aug. 26, 2021, 10 pages.

PCT/US2020/018350—International Search Report and Written Opinion, dated Aug. 6, 2020, 18 pages.

Ambrosi, et al., "Congenital heart block: evidence for a pathogenic role of maternal autoantibodies", *Arthritis Research & Therapy*, 2012, 14:208. pp. 1-11.

Aulas, et al., "Stress-specific differences in assembly and composition of stress granules and related foci", *J. Cell Sci.*, Mar. 1, 2017; vol. 130, No. 5: pp. 927-937.

Boehme, et al., "Innate Sensing of Viruses by Toll-Like Receptors", *Journal of Virology*, Aug. 2004, vol. 78, No. 15, pp. 7867-7873.

Carmi, et al., "Allogeneic IgG combined with dendritic cell stimuli induce antitumour T-cell immunity", *Nature*, May 7, 2015, vol. 521, pp. 99-104.

DeFalco, et al., "Non-progressing cancer patients have persistent B cell responses expressing shared antibody paratopes that target public tumor antigens", *Clinical Immunology*, 187 (2018), pp. 37-45.

Ditlev, et al., "Who's In and Who's Out-Compositional Control of Biomolecular Condensates", *Journal of Molecular Biology*, vol. 430, Issue 23, Nov. 2, 2018, pp. 4666-4684.

(Continued)

*Primary Examiner* — Laura B Goddard
*Assistant Examiner* — Sarah A Alsomairy
(74) *Attorney, Agent, or Firm* — Kilpatrick Townsend & Stockton LLP

(57) ABSTRACT

Provided herein are antibodies that bind to tumor tissue through a binding interaction with an extracellular RNA-protein complex. Such antibodies are used in methods of inducing an immune response and methods of inhibiting tumor cell growth. Additionally provided are methods of producing such antibodies.

36 Claims, 87 Drawing Sheets

Specification includes a Sequence Listing.

(56) References Cited

OTHER PUBLICATIONS

Eliseeva, et al., "Poly(A) Binding Proteins: Structure, Domain Organization, and Activity Regulation", *Biochemistry* (Moscow), 2013, vol. 78, No. 13, pp. 1377-1391.
Guillen-Boixent, et al. "RNA-Induced Confrormational Switching and Clustering of G3BP Drive Stress Granule Assembly by Condensation", *Cell* 181, Apr. 16, 2020, pp. 346-361.
Guilliams, et al., "The function of Fcγ receptors in dendritic cells and macrophages", *Nat Rev Immunol.*, 2014, vol. 14, No. 2, pp. 94-108.
Hyman, et al., "Liquid-Liquid Phase Separation in Biology", *Annu Rev. Cell Div. Biol.*, 2014, vol. 30, pp. 39-58.
Jain, et al. "A Tpase-Modulated Stress Granules Contain a Diverse Proteome and Substructure", *Cell 164*, Jan. 28, 2016, pp. 487-498.
Mahboubi, et al., "Cytoplasmic stress granules: Dynamic modulators of cell signaling and disease", *Biochimica et Biophysica Acta*, 2017, pp. 884-895.
Markmiller, et al., "Context-Dependent and Disease-Specific Diversity in Protein Interactions within Stress Granules", *Cell 172*, Jan. 25, 2018, pp. 590-604.
Morita, et al., The stress granule protein Vgl1 and poly(A)-binding protein Pab1 are required for doxorubicin resistance in the fission yeast *Schizosaccharomyces pombe, Biochemical and Biophysical Research Communications*, Jan. 2012, vol. 417, No. 1, pp. 399-403.
Mullard, "Biomolecular condensates pique drug discovery curiosity", *Nature*, May 2010, vol. 18, pp. 324-326.
Musunuru, et al., "Paraneoplastic Neurologic Disease Antigens: RNA-Binding Proteins and Signaling Proteins in Neuronal Degeneration", *Neuroscience*, 2001, vol. 24, pp. 239-262.
Periera, et al., "RNA-Binding Proteins in Cancer: Old Players and New Actores", *Trends in Cancer*, Jul. 2017, vol. 3, No. 7, pp. 506-528.
Protter, et al., "Principles and Properties of Stress Granules", *Treands Cell Biol*, Sep. 2016, vol. 26, No. 9 pp. 668-679.
Rozelle, et al., "Activation of Stress Response Pathways Promotes Formation of Antiviral Granules and Restricts Virus Replication", *Molecular and Cellular Biology*, Jun. 2014, vol. 34, No. 11, pp. 2003-2015.
Tourriere, et al., "The RasGAP-associated endoribonuclease G3BP assembles stress granules", *The Journal of Cell Biology*, Mar. 17, 2003, vol. 160, No. 6, pp. 823-831.
Vilas-Boas Fde A, et al., "Impairment of stress granule assembly via inhibition of the eIF2alpha phosphorylation sensitizes glioma cells to chemotherapeutic agents", *Journal of Neuro-oncology*, Apr. 2016; vol. 127, No. 2, pp. 253-260.
Wheller, et al., "Isolation of yeast and mammalian stress granule cores", *Methods*, Aug. 15, 2017, vol. 126, pp. 12-17.
Wolin, Sandra, "RNPs and autoimmunity: 20 years later", *RNA*, published by Cold Spring Harbour Laboratory Press for RNA Society, 2015, vol. 21, pp. 548-549.
Youn, et al., "High-Density Proximity Mapping Reveals the Subcellular Organization of mRNA-Associated Granules and Bodies", *Molecular Cell*, Feb. 1, 2018, vol. 69, pp. 517-532.

* cited by examiner

First Generation Lead Variants in EMT6 Tumor Model-Tumor Growth

Variants in EMT6 Tumor Model - Tumor Growth

Stay Design

| | Groups | #mice | Article 1 | | | | Article 2 | | | |
|---|---|---|---|---|---|---|---|---|---|---|
| | | | | mpk | Frequency | Route | | mpk | Frequency | Route |
| 1 | PD1 + AIP-192482 | 20 | PD-1 (RMP1-14) | 10 | TWx2 | i.p. | AIP-192482 | 5 | TWx3.5 | i.p. |
| 2 | PD1 + AIP-192482 | 20 | PD-1 (RMP1-14) | 10 | TWx2 | i.p. | AIP-192482 | 10 | TWx3.5 | i.p. |
| 3 | PD1 + AIP-133645 | 20 | PD-1 (RMP1-14) | 10 | TWx2 | i.p. | AIP-133645 | 5 | TWx3.5 | i.p. |
| 4 | PD1 + AIP-133645 | 20 | PD-1 (RMP1-14) | 10 | TWx2 | i.p. | AIP-133645 | 2.5 | TWx3.5 | i.p. |
| 5 | PD1 + AIP-160470 | 20 | PD-1 (RMP1-14) | 10 | TWx2 | i.p. | AIP-160470 | 5 | TWx3.5 | i.p. |
| 6 | PD1 + AIP-160470 | 20 | PD-1 (RMP1-14) | 10 | TWx2 | i.p. | AIP-160470 | 2.5 | TWx3.5 | i.p. |
| 7 | PBS + AIP-192482 | 20 | Vehicle | 0 | TWx2 | i.p. | AIP-192482 | 5 | TWx3.5 | i.p. |
| 8 | PBS + AIP-192482 | 20 | Vehicle | 0 | TWx2 | i.p. | AIP-192482 | 10 | TWx3.5 | i.p. |
| 9 | PBS + AIP-133645 | 20 | Vehicle | 0 | TWx2 | i.p. | AIP-133645 | 5 | TWx3.5 | i.p. |
| 10 | PBS + AIP-133645 | 20 | Vehicle | 0 | TWx2 | i.p. | AIP-133645 | 2.5 | TWx3.5 | i.p. |
| 11 | PBS + AIP-160470 | 20 | Vehicle | 0 | TWx2 | i.p. | AIP-160470 | 5 | TWx3.5 | i.p. |
| 12 | PBS + AIP-160470 | 20 | Vehicle | 0 | TWx2 | i.p. | AIP-160470 | 2.5 | TWx3.5 | i.p. |
| 13 | AIP-192482 (CHO cells) | 20 | Vehicle | 0 | TWx2 | i.p. | AIP-192482 | 10 | TWx3.5 | i.p. |
| 14 | PD1 + PBS | 20 | PD-1 (RMP1-14) | 10 | TWx2 | i.p. | Vehicle | 0 | TWx3.5 | i.p. |
| 15 | PBS + PBS | 20 | Vehicle | 0 | TWx2 | i.p. | Vehicle | 0 | TWx3.5 | i.p. |

FIG. 8

AIP-157397: increase signal in tumor with TAT signal; titrates to no TAT signal

AIP-165430: increase signal in tumor with minimal increase in TAT

**Schematic of the *ex vivo* Binding Assay**
Generation of ex vivo cells
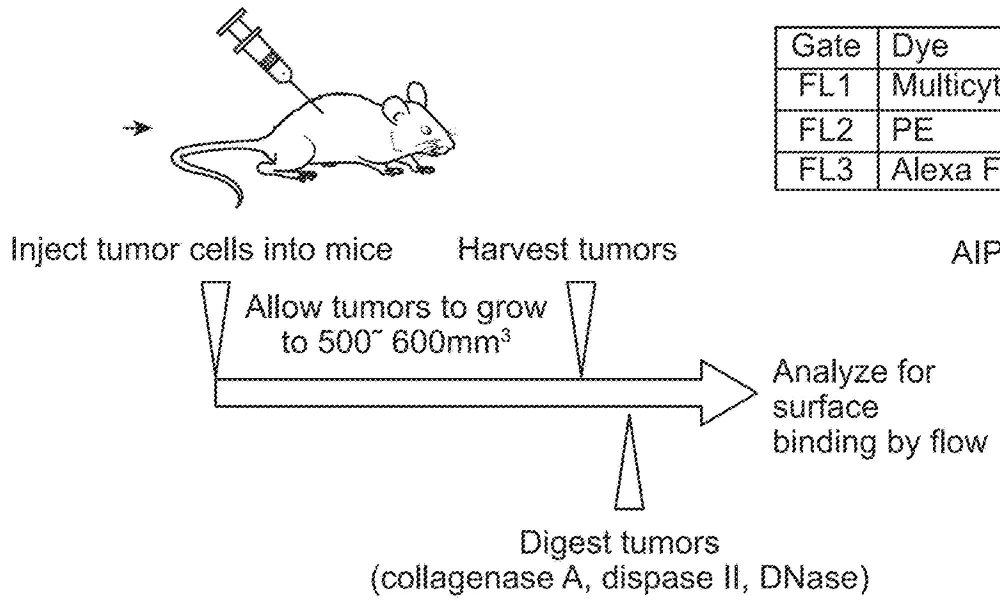
Flow cytometry
| Gate | Dye | Readout function |
|---|---|---|
| FL1 | Multicyt membrane integrity dye | Live/dead |
| FL2 | PE | CD45+/- |
| FL3 | Alexa Flour 647 | Antibody surface binding |
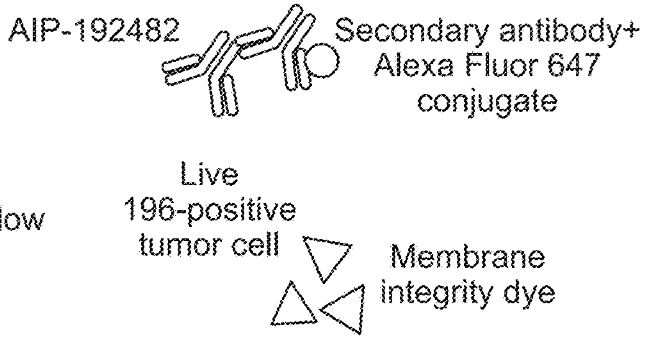
| | |
|---|---|
| CD45- | Enriched tumor cells |
| CD45+ | Leukocytes |
FIG. 25

Binding of Variants to EMT6 ex vivo Cells Correlates with in vivo Data

Treatment of Immunoprecipitates with RNase or DNase

AIP-192482 Co-locates with a Subpopulation of G3BP-Positive Structures within EMT6 Tumors Co-distribution of AIP-160470 and CD9 Immunoreactivities in EMT6 Tumor

CD9/ AIP-160470/ HOECHST

Co-distribution of AIP-160470 and CD9 Immunoreactivities in Human Breast Carcinoma

CD9/ AIP-160470/ HOECHST

Kabat Chothia IMGT Numbering of AIP-160470 $V_H$

| | | | | | | | | | | | | | | | | | | | | |
|---|---|---|---|---|---|---|---|---|---|---|---|---|---|---|---|---|---|---|---|---|
| Kabat: | 1 | 2 | 3 | 4 | 5 | 6 | 7 | 8 | 9 | 10 | 11 | 12 | 13 | 14 | 15 | 16 | 17 | 18 | 19 | 20 |
| Chothia: | 1 | 2 | 3 | 4 | 5 | 6 | 7 | 8 | 9 | 10 | 11 | 12 | 13 | 14 | 15 | 16 | 17 | 18 | 19 | 20 |
| IMGT: | 1 | 2 | 3 | 4 | 5 | 6 | 7 | 8 | 9 | 11 | 12 | 13 | 14 | 15 | 16 | 17 | 18 | 19 | 20 | 21 |
| AIP-160470 | E | V | Q | L | V | E | S | G | G | A | L | V | K | P | G | G | S | L | R | L |

| | | | | | | | | | | | | | | | | | | | | |
|---|---|---|---|---|---|---|---|---|---|---|---|---|---|---|---|---|---|---|---|---|
| Kabat: | 21 | 22 | 23 | 24 | 25 | 26 | 27 | 28 | 29 | 30 | 31 | 32 | 33 | 34 | 35 | 36 | 37 | 38 | 39 | 40 |
| Chothia: | 21 | 22 | 23 | 24 | 25 | 26 | 27 | 28 | 29 | 30 | 31 | 32 | 33 | 34 | 35 | 36 | 37 | 38 | 39 | 40 |
| IMGT: | 22 | 23 | 24 | 25 | 26 | 27 | 28 | 29 | 30 | 35 | 36 | 37 | 38 | 39 | 40 | 41 | 42 | 43 | 44 | 45 |
| AIP-160470 | S | C | A | A | S | G | F | T | F | S | K | A | W | M | S | W | V | R | Q | A |

| | | | | | | | | | | | | | | | | | | | | |
|---|---|---|---|---|---|---|---|---|---|---|---|---|---|---|---|---|---|---|---|---|
| Kabat: | 41 | 42 | 43 | 44 | 45 | 46 | 47 | 48 | 49 | 50 | 51 | 52 | 52a | 52b | 52c | 53 | 54 | 55 | 56 | 57 |
| Chothia: | 41 | 42 | 43 | 44 | 45 | 46 | 47 | 48 | 49 | 50 | 51 | 52 | 52a | 52b | 52c | 53 | 54 | 55 | 56 | 57 |
| IMGT: | 46 | 47 | 48 | 49 | 50 | 51 | 52 | 53 | 54 | 55 | 56 | 57 | 58 | 59 | 60 | 61 | 62 | 63 | 64 | 65 |
| AIP-160470 | P | G | K | G | L | E | W | V | G | R | I | K | S | V | T | D | G | E | T | T |

| | | | | | | | | | | | | | | | | | | | | |
|---|---|---|---|---|---|---|---|---|---|---|---|---|---|---|---|---|---|---|---|---|
| Kabat: | 58 | 59 | 60 | 61 | 62 | 63 | 64 | 65 | 66 | 67 | 68 | 69 | 70 | 71 | 72 | 73 | 74 | 75 | 76 | 77 |
| Chothia: | 58 | 59 | 60 | 61 | 62 | 63 | 64 | 65 | 66 | 67 | 68 | 69 | 70 | 71 | 72 | 73 | 74 | 75 | 76 | 77 |
| IMGT: | 66 | 67 | 68 | 69 | 70 | 71 | 72 | 74 | 75 | 76 | 77 | 78 | 79 | 80 | 81 | 82 | 83 | 84 | 85 | 86 |
| AIP-160470 | D | Y | A | A | P | V | K | G | R | F | T | I | S | R | D | D | S | K | S | T |

| | | | | | | | | | | | | | | | | | | | | |
|---|---|---|---|---|---|---|---|---|---|---|---|---|---|---|---|---|---|---|---|---|
| Kabat: | 78 | 79 | 80 | 81 | 82 | 82a | 82b | 82c | 83 | 84 | 85 | 86 | 87 | 88 | 89 | 90 | 91 | 92 | 93 | 94 |
| Chothia: | 78 | 79 | 80 | 81 | 82 | 82a | 82b | 82c | 83 | 84 | 85 | 86 | 87 | 88 | 89 | 90 | 91 | 92 | 93 | 94 |
| IMGT: | 87 | 88 | 89 | 90 | 91 | 92 | 93 | 94 | 95 | 96 | 97 | 98 | 99 | 100 | 101 | 102 | 103 | 104 | 105 | 106 |
| AIP-160470 | L | Y | L | Q | M | N | S | L | K | T | E | D | T | A | V | Y | Y | C | T | S |

FIG. 37A

| | | | | | | | | | | | | | | | | |
|---|---|---|---|---|---|---|---|---|---|---|---|---|---|---|---|---|
| Kabat: | 95 | 96 | 97 | 98 | 99 | 100 | 100a | 100b | 100c | 100d | 100e | 100f | 100g | 100h | 100i | 100j |
| Chothia: | 95 | 96 | 97 | 98 | 99 | 100 | 100a | 100b | 100c | 100d | 100e | 100f | 100g | 100h | 100i | 100j |
| IMGT: | 107 | 108 | 109 | 110 | 111 | 111.1 | 111.2 | 111.3 | 111.4 | 111.5 | 111.6 | 111.7 | 111.8 | 111.9 | 112.9 | 112.8 |
| AIP-160470 | S | F | C | C | R | G | G | S | C | P | S | H | D | T | S | Y |

| | | | | | | | | | | | | | | | | |
|---|---|---|---|---|---|---|---|---|---|---|---|---|---|---|---|---|
| Kabat: | 100k | 100l | 100m | 100n | 100o | 100p | 100q | 100r | 100s | 100t | 100u | 101 | 102 | 103 | 104 | 105 |
| Chothia: | 100k | 100l | 100m | 100n | 100o | 100p | 100q | 100r | 100s | 100t | 100u | 101 | 102 | 103 | 104 | 105 |
| IMGT: | 112.7 | 112.6 | 112.5 | 112.4 | 112.3 | 112.2 | 112.1 | 112 | 113 | 114 | 115 | 116 | 117 | 118 | 119 | 120 |
| AIP-160470 | C | G | G | Q | Y | K | S | Y | Y | Y | M | D | V | W | G | K |

| | | | | | | | | |
|---|---|---|---|---|---|---|---|---|
| Kabat: | 106 | 107 | 108 | 109 | 110 | 111 | 112 | 113 |
| Chothia: | 106 | 107 | 108 | 109 | 110 | 111 | 112 | 113 |
| IMGT: | 121 | 122 | 123 | 124 | 125 | 126 | 127 | 128 |
| AIP-160470 | G | T | T | V | T | V | S | S |

FIG. 37AA

Kabat Chothia IMGT Numbering of AIP-160470 $V_L$

| Kabat: | 1 | 2 | 3 | 4 | 5 | 6 | 7 | 8 | 9 | 11 | 12 | 13 | 14 | 15 | 16 | 17 | 18 | 19 | 20 | 21 |
|---|---|---|---|---|---|---|---|---|---|---|---|---|---|---|---|---|---|---|---|---|
| Chothia: | 1 | 2 | 3 | 4 | 5 | 6 | 7 | 8 | 9 | 11 | 12 | 13 | 14 | 15 | 16 | 17 | 18 | 19 | 20 | 21 |
| IMGT: | 1 | 2 | 3 | 4 | 5 | 6 | 7 | 8 | 9 | 11 | 12 | 13 | 14 | 15 | 16 | 17 | 18 | 19 | 20 | 21 |
| AIP-160470 | Q | S | V | L | T | Q | P | P | S | A | S | G | T | P | G | Q | R | V | T | I |

| Kabat: | 22 | 23 | 24 | 25 | 26 | 27 | 27a | 27b | 28 | 29 | 30 | 31 | 32 | 33 | 34 | 35 | 36 | 37 | 38 | 39 |
|---|---|---|---|---|---|---|---|---|---|---|---|---|---|---|---|---|---|---|---|---|
| Chothia: | 22 | 23 | 24 | 25 | 26 | 27 | 28 | 29 | 30 | 30a | 30b | 31 | 32 | 33 | 34 | 35 | 36 | 37 | 38 | 39 |
| IMGT: | 22 | 23 | 24 | 25 | 26 | 27 | 28 | 29 | 30 | 35 | 36 | 37 | 38 | 39 | 40 | 41 | 42 | 43 | 44 | 45 |
| AIP-160470 | S | C | S | G | S | S | S | N | I | G | S | S | S | V | S | W | Y | Q | Q | L |

| Kabat: | 40 | 41 | 42 | 43 | 44 | 45 | 46 | 47 | 48 | 49 | 50 | 51 | 52 | 53 | 54 | 55 | 56 | 57 | 58 | 59 |
|---|---|---|---|---|---|---|---|---|---|---|---|---|---|---|---|---|---|---|---|---|
| Chothia: | 40 | 41 | 42 | 43 | 44 | 45 | 46 | 47 | 48 | 49 | 50 | 51 | 52 | 53 | 54 | 55 | 56 | 57 | 58 | 59 |
| IMGT: | 46 | 47 | 48 | 49 | 50 | 51 | 52 | 53 | 54 | 55 | 56 | 57 | 65 | 66 | 67 | 68 | 69 | 70 | 71 | 72 |
| AIP-160470 | P | G | T | A | P | K | L | L | I | Y | K | N | N | Q | R | P | S | G | V | P |

| Kabat: | 60 | 61 | 62 | 63 | 64 | 65 | 66 | 67 | 68 | 69 | 70 | 71 | 72 | 73 | 74 | 75 | 76 | 77 | 78 | 79 |
|---|---|---|---|---|---|---|---|---|---|---|---|---|---|---|---|---|---|---|---|---|
| Chothia: | 60 | 61 | 62 | 63 | 64 | 65 | 66 | 67 | 68 | 69 | 70 | 71 | 72 | 73 | 74 | 75 | 76 | 77 | 78 | 79 |
| IMGT: | 74 | 75 | 76 | 77 | 78 | 79 | 80 | 83 | 84 | 85 | 86 | 87 | 88 | 89 | 90 | 91 | 92 | 93 | 94 | 95 |
| AIP-160470 | D | R | F | S | G | S | K | S | G | T | S | A | S | L | A | I | S | G | L | R |

FIG. 37B

| Kabat: | 80 | 81 | 82 | 83 | 84 | 85 | 86 | 87 | 88 | 89 | 90 | 91 | 92 | 93 | 94 | 95 | 95a | 95b | 96 | 97 |
|---|---|---|---|---|---|---|---|---|---|---|---|---|---|---|---|---|---|---|---|---|
| Chothia: | 80 | 81 | 82 | 83 | 84 | 85 | 86 | 87 | 88 | 89 | 90 | 91 | 92 | 93 | 94 | 95 | 95a | 95b | 96 | 97 |
| IMGT: | 96 | 97 | 98 | 99 | 100 | 101 | 102 | 103 | 104 | 105 | 106 | 107 | 108 | 109 | 110 | 113 | 114 | 115 | 116 | 117 |
| AIP-160470 | S | E | D | E | A | D | Y | Y | C | S | T | W | D | D | S | L | S | V | R | V |

| Kabat: | 98 | 99 | 100 | 101 | 102 | 103 | 104 | 105 | 106 | 107 |
|---|---|---|---|---|---|---|---|---|---|---|
| Chothia: | 98 | 99 | 100 | 101 | 102 | 103 | 104 | 105 | 106 | 107 |
| IMGT: | 118 | 119 | 120 | 121 | 122 | 123 | 124 | 125 | 126 | 127 |
| AIP-160470 | F | G | G | G | T | K | L | T | V | L |

FIG. 37BB

| Sample | Qubit ng/uL |
|---|---|
| Control IP | 63.2 |
| AIP-192482 IP | >1000 |

| Gene | Control Ab Rd 1 | Control Ab Rd 2 | AIP-192482 Exp 1 | AIP-192482 Exp 2 |
|---|---|---|---|---|
| CCDC125 | 0.00E+00 | 0.00E+00 | 2.53E-06 | 0.00E+00 |
| PARP15 | 0.00E+00 | 0.00E+00 | 3.80E-06 | 0.00E+00 |
| AC007620.3 | 0.00E+00 | 0.00E+00 | 1.27E-06 | 0.00E+00 |
| TMEM182 | 0.00E+00 | 0.00E+00 | 5.06E-06 | 0.00E+00 |
| F11R | 0.00E+00 | 0.00E+00 | 1.27E-05 | 5.64E-05 |
| SLC38A6 | 0.00E+00 | 0.00E+00 | 1.27E-06 | 0.00E+00 |
| RPAIN | 0.00E+00 | 0.00E+00 | 1.01E-05 | 2.82E-05 |
| CTC-260E6.6 | 0.00E+00 | 0.00E+00 | 0.00E+00 | 2.82E-05 |
| KTN1-AS1 | 0.00E+00 | 0.00E+00 | 0.00E+00 | 0.00E+00 |
| MAB21L3 | 0.00E+00 | 0.00E+00 | 8.86E-06 | 0.00E+00 |

FIG. 38B

EC50 Rank (Expressed as fold over AIP-160470
0= >500 nM; 1 = <0.5; 2 = 0.5 to 2; 3 = 2 to 4; 4 = >4
ΔActivity Rank (relative to AIP-160470
0 = <0.12; 1= 0.12 to 0.3; 2 = 0.3 to 0.75; 3 = > 0.75

| AIP Number | Number of Expts | $EC_{50}$ (nM) | $EC_{50}$ Rank | ΔActivity (relative to AIP-160470) | ΔActivity Rank |
|---|---|---|---|---|---|
| AIP-109729 | 1 | 13 | 4.0 | 0.57 | 2.0 |
| AIP-128136 | 3 | 1 | 4.0 | 1.21 | 3.0 |
| AIP-131972 | 1 | 2 | 4.0 | 0.79 | 3.0 |
| AIP-153125 | 3 | 2 | 4.0 | 0.99 | 3.0 |
| AIP-157045 | 2 | 21 | 4.0 | 1.21 | 3.0 |
| AIP-160829 | 2 | 17 | 4.0 | 1.04 | 3.0 |
| AIP-181273 | 3 | 9 | 4.0 | 1.12 | 3.0 |
| AIP-189526 | 2 | 12 | 4.0 | 0.98 | 3.0 |
| AIP-125062 | 2 | 21 | 3.5 | 1.03 | 3.0 |
| AIP-125258 | 2 | 31 | 3.5 | 0.91 | 3.0 |
| AIP-150199 | 2 | 26 | 3.5 | 1.00 | 3.0 |
| AIP-166722 | 2 | 29 | 3.5 | 0.49 | 2.0 |
| AIP-170105 | 2 | 28 | 3.5 | 0.88 | 3.0 |
| AIP-180422 | 2 | 32 | 3.5 | 0.63 | 2.0 |
| AIP-180675 | 2 | 17 | 3.5 | 0.78 | 2.5 |
| AIP-184744 | 2 | 24 | 3.5 | 0.84 | 2.5 |
| AIP-102624 | 1 | 50 | 3.0 | 0.47 | 2.0 |
| AIP-115363 | 1 | 29 | 3.0 | 0.90 | 3.0 |
| AIP-128147 | 2 | 32 | 3.0 | 0.84 | 2.5 |
| AIP-154181 | 2 | 46 | 3.0 | 0.69 | 2.0 |
| AIP-157078 | 1 | 51 | 3.0 | 0.67 | 2.0 |
| AIP-174676 | 1 | 40 | 3.0 | 0.33 | 2.0 |
| AIP-101601 | 2 | 42 | 2.5 | 0.67 | 2.5 |
| AIP-109048 | 2 | 40 | 2.5 | 0.74 | 2.5 |
| AIP-111240 | 2 | 50 | 2.5 | 0.89 | 3.0 |
| AIP-114403 | 2 | 46 | 2.5 | 0.83 | 2.5 |
| AIP-127782 | 2 | 76 | 2.5 | 1.05 | 3.0 |
| AIP-129145 | 2 | 39 | 2.5 | 0.63 | 2.0 |
| AIP-136060 | 2 | 51 | 2.5 | 0.85 | 2.5 |
| AIP-148062 | 2 | 47 | 2.5 | 0.79 | 3.0 |
| AIP-162041 | 2 | 47 | 2.5 | 0.84 | 3.0 |
| AIP-167533 | 2 | 52 | 2.5 | 0.55 | 2.0 |
| AIP-190051 | 2 | 43 | 2.5 | 0.79 | 3.0 |
| AIP-100340 | 1 | 152 | 2.0 | 0.31 | 2.0 |
| AIP-101235 | 2 | 51 | 2.0 | 0.95 | 3.0 |
| AIP-102299 | 2 | 93 | 2.0 | 0.63 | 2.0 |
| AIP-104086 | 2 | 104 | 2.0 | 0.87 | 3.0 |

FIG. 39A

| AIP Number | Number of Expts | $EC_{50}$ (nM) | $EC_{50}$ Rank | ΔActivity (relative to AIP-160470) | ΔActivity Rank |
|---|---|---|---|---|---|
| AIP-104364 | 1 | 148 | 2.0 | 0.22 | 1.0 |
| AIP-105241 | 1 | 86 | 2.0 | 0.43 | 2.0 |
| AIP-106633 | 2 | 95 | 2.0 | 0.67 | 2.0 |
| AIP-107759 | 2 | 111 | 2.0 | 0.68 | 2.0 |
| AIP-109343 | 2 | 53 | 2.0 | 0.80 | 2.5 |
| AIP-109484 | 1 | 134 | 2.0 | 0.59 | 2.0 |
| AIP-109510 | 1 | 79 | 2.0 | 0.63 | 2.0 |
| AIP-110143 | 1 | 111 | 2.0 | 0.83 | 3.0 |
| AIP-112328 | 1 | 174 | 2.0 | 0.65 | 2.0 |
| AIP-112580 | 2 | 84 | 2.0 | 0.77 | 2.5 |
| AIP-113513 | 1 | 169 | 2.0 | 0.59 | 2.0 |
| AIP-114196 | 1 | 102 | 2.0 | 0.64 | 2.0 |
| AIP-116142 | 1 | 172 | 2.0 | 0.60 | 2.0 |
| AIP-116579 | 3 | 143 | 2.0 | 0.64 | 2.0 |
| AIP-119622 | 2 | 94 | 2.0 | 0.77 | 2.5 |
| AIP-119664 | 2 | 96 | 2.0 | 0.71 | 2.5 |
| AIP-124314 | 3 | 161 | 2.0 | 0.91 | 2.7 |
| AIP-125984 | 2 | 80 | 2.0 | 0.72 | 2.5 |
| AIP-126285 | 2 | 71 | 2.0 | 0.77 | 2.5 |
| AIP-127108 | 1 | 68 | 2.0 | 0.49 | 2.0 |
| AIP-128195 | 3 | 138 | 2.0 | 0.52 | 2.0 |
| AIP-128243 | 1 | 111 | 2.0 | 0.70 | 2.0 |
| AIP-130491 | 1 | 107 | 2.0 | 0.75 | 3.0 |
| AIP-130915 | 2 | 60 | 2.0 | 0.84 | 2.5 |
| AIP-133650 | 1 | 119 | 2.0 | 0.58 | 2.0 |
| AIP-134312 | 1 | 179 | 2.0 | 0.78 | 3.0 |
| AIP-134770 | 3 | 90 | 2.0 | 0.88 | 3.0 |
| AIP-136628 | 1 | 126 | 2.0 | 0.50 | 2.0 |
| AIP-137169 | 1 | 57 | 2.0 | 0.38 | 2.0 |
| AIP-138776 | 1 | 97 | 2.0 | 0.66 | 2.0 |
| AIP-141887 | 3 | 103 | 2.0 | 0.53 | 2.0 |
| AIP-142489 | 3 | 177 | 2.0 | 0.75 | 2.3 |
| AIP-143132 | 1 | 60 | 2.0 | 0.65 | 2.0 |
| AIP-143155 | 1 | 68 | 2.0 | 0.54 | 2.0 |
| AIP-143179 | 3 | 88 | 2.0 | 0.69 | 2.3 |
| AIP-146871 | 1 | 185 | 2.0 | 0.50 | 2.0 |
| AIP-147176 | 1 | 85 | 2.0 | 0.63 | 2.0 |
| AIP-147389 | 1 | 97 | 2.0 | 0.56 | 2.0 |
| AIP-150055 | 1 | 136 | 2.0 | 0.55 | 2.0 |
| AIP-151167 | 1 | 83 | 2.0 | 0.48 | 2.0 |
| AIP-151709 | 1 | 154 | 2.0 | 0.65 | 2.0 |
| AIP-152283 | 1 | 75 | 2.0 | 0.34 | 2.0 |
| AIP-153462 | 3 | 87 | 2.0 | 0.83 | 2.3 |
| AIP-153475 | 1 | 116 | 2.0 | 1.00 | 3.0 |

FIG. 39B

| AIP Number | Number of Expts | EC50 (nM) | EC50 Rank | ΔActivity (relative to AIP-160470) | ΔActivity Rank |
|---|---|---|---|---|---|
| AIP-153888 | 2 | 67 | 2.0 | 0.71 | 2.0 |
| AIP-154873 | 2 | 89 | 2.0 | 0.65 | 2.0 |
| AIP-156514 | 2 | 81 | 2.0 | 0.64 | 2.0 |
| AIP-156760 | 1 | 58 | 2.0 | 0.64 | 2.0 |
| AIP-158623 | 1 | 90 | 2.0 | 0.71 | 2.0 |
| AIP-159023 | 1 | 170 | 2.0 | 0.33 | 2.0 |
| AIP-159037 | 2 | 67 | 2.0 | 0.72 | 2.5 |
| AIP-159326 | 2 | 69 | 2.0 | 0.97 | 3.0 |
| AIP-160470 | 54 | 107 | 2.0 | 1.00 | 3.0 |
| AIP-161082 | 1 | 118 | 2.0 | 0.79 | 3.0 |
| AIP-164754 | 1 | 89 | 2.0 | 0.36 | 2.0 |
| AIP-166120 | 2 | 72 | 2.0 | 0.92 | 3.0 |
| AIP-166832 | 2 | 42 | 2.0 | 0.61 | 2.0 |
| AIP-166959 | 1 | 135 | 2.0 | 0.46 | 2.0 |
| AIP-167246 | 1 | 57 | 2.0 | 0.70 | 2.0 |
| AIP-167726 | 3 | 204 | 2.0 | 0.63 | 2.3 |
| AIP-168083 | 1 | 115 | 2.0 | 0.81 | 3.0 |
| AIP-168605 | 2 | 71 | 2.0 | 0.60 | 2.0 |
| AIP-169636 | 1 | 99 | 2.0 | 0.61 | 2.0 |
| AIP-170053 | 1 | 118 | 2.0 | 0.51 | 2.0 |
| AIP-170569 | 2 | 76 | 2.0 | 0.68 | 2.0 |
| AIP-172872 | 2 | 98 | 2.0 | 0.46 | 2.0 |
| AIP-173276 | 1 | 98 | 2.0 | 0.54 | 2.0 |
| AIP-175775 | 2 | 90 | 2.0 | 0.80 | 2.5 |
| AIP-177584 | 1 | 137 | 2.0 | 0.34 | 2.0 |
| AIP-179097 | 2 | 82 | 2.0 | 0.80 | 3.0 |
| AIP-181246 | 2 | 161 | 2.0 | 0.74 | 2.0 |
| AIP-183133 | 1 | 136 | 2.0 | 0.49 | 2.0 |
| AIP-183190 | 1 | 68 | 2.0 | 0.57 | 2.0 |
| AIP-183350 | 2 | 76 | 2.0 | 0.88 | 3.0 |
| AIP-184151 | 1 | 191 | 2.0 | 0.46 | 2.0 |
| AIP-185291 | 1 | 123 | 2.0 | 0.59 | 2.0 |
| AIP-185304 | 1 | 174 | 2.0 | 0.70 | 2.0 |
| AIP-186435 | 2 | 136 | 2.0 | 0.44 | 2.0 |
| AIP-186826 | 2 | 108 | 2.0 | 0.62 | 2.0 |
| AIP-188155 | 2 | 111 | 2.0 | 0.80 | 2.5 |
| AIP-189338 | 3 | 120 | 2.0 | 0.81 | 3.0 |
| AIP-189473 | 2 | 85 | 2.0 | 0.84 | 2.5 |
| AIP-189475 | 2 | 147 | 2.0 | 0.62 | 2.0 |
| AIP-190274 | 2 | 120 | 2.0 | 0.74 | 2.5 |
| AIP-190362 | 1 | 99 | 2.0 | 0.39 | 2.0 |
| AIP-190526 | 1 | 57 | 2.0 | 0.71 | 2.0 |
| AIP-190761 | 2 | 104 | 2.0 | 0.77 | 2.5 |
| AIP-190915 | 1 | 174 | 2.0 | 0.83 | 3.0 |

FIG. 39C

| AIP Number | Number of Expts | $EC_{50}$ (nM) | $EC_{50}$ Rank | ΔActivity (relative to AIP-160470) | ΔActivity Rank |
|---|---|---|---|---|---|
| AIP-191735 | 2 | 70 | 2.0 | 0.85 | 2.5 |
| AIP-192216 | 2 | 155 | 2.0 | 0.54 | 2.0 |
| AIP-192275 | 2 | 103 | 2.0 | 0.72 | 2.0 |
| AIP-192571 | 2 | 110 | 2.0 | 0.66 | 2.0 |
| AIP-193490 | 1 | 158 | 2.0 | 0.16 | 1.0 |
| AIP-195587 | 3 | 99 | 2.0 | 0.81 | 3.0 |
| AIP-195588 | 1 | 107 | 2.0 | 0.70 | 2.0 |
| AIP-197886 | 1 | 106 | 2.0 | 0.40 | 2.0 |
| AIP-198351 | 2 | 51 | 2.0 | 0.87 | 3.0 |
| AIP-199834 | 3 | 114 | 2.0 | 0.77 | 2.3 |
| AIP-102396 | 2 | 139 | 1.5 | 0.56 | 2.0 |
| AIP-103817 | 2 | 177 | 1.5 | 0.79 | 2.5 |
| AIP-106139 | 2 | 148 | 1.5 | 0.81 | 2.5 |
| AIP-126080 | 2 | 191 | 1.5 | 0.65 | 2.5 |
| AIP-143369 | 2 | 196 | 1.5 | 0.69 | 2.5 |
| AIP-155066 | 2 | 165 | 1.5 | 0.82 | 2.5 |
| AIP-160621 | 2 | 286 | 1.5 | 0.54 | 2.0 |
| AIP-161571 | 2 | 122 | 1.5 | 0.58 | 2.0 |
| AIP-187893 | 2 | 154 | 1.5 | 0.85 | 3.0 |
| AIP-191470 | 2 | 118 | 1.5 | 0.71 | 2.5 |
| AIP-197809 | 2 | 307 | 1.5 | 0.63 | 2.0 |
| AIP-199483 | 2 | 179 | 1.5 | 0.60 | 2.0 |
| AIP-135247 | 3 | 233 | 1.3 | 0.66 | 2.0 |
| AIP-192329 | 3 | 221 | 1.3 | 0.56 | 2.0 |
| AIP-102833 | 1 | 300 | 1.0 | 0.60 | 2.0 |
| AIP-103803 | 1 | 198 | 1.0 | 0.71 | 2.0 |
| AIP-104188 | 1 | 433 | 1.0 | 0.17 | 1.0 |
| AIP-115388 | 2 | 319 | 1.0 | 0.92 | 3.0 |
| AIP-118505 | 1 | 297 | 1.0 | 0.46 | 2.0 |
| AIP-120546 | 1 | 327 | 1.0 | 0.54 | 2.0 |
| AIP-122563 | 1 | 260 | 1.0 | 0.63 | 2.0 |
| AIP-124013 | 1 | 263 | 1.0 | 0.57 | 2.0 |
| AIP-126175 | 1 | 483 | 1.0 | 0.36 | 2.0 |
| AIP-133645 | 1 | 154 | 1.0 | 0.64 | 2.0 |
| AIP-136538 | 1 | 471 | 1.0 | 0.56 | 2.0 |
| AIP-142079 | 1 | 148 | 1.0 | 0.75 | 3.0 |
| AIP-145518 | 1 | 308 | 1.0 | 0.78 | 3.0 |
| AIP-145722 | 1 | 310 | 1.0 | 0.69 | 2.0 |
| AIP-147652 | 1 | 456 | 1.0 | 0.58 | 2.0 |
| AIP-148327 | 1 | 452 | 1.0 | 0.03 | 0.0 |
| AIP-150485 | 1 | 336 | 1.0 | 0.63 | 2.0 |
| AIP-151090 | 1 | 231 | 1.0 | 0.87 | 3.0 |
| AIP-152243 | 1 | 402 | 1.0 | 0.65 | 2.0 |
| AIP-157122 | 2 | 174 | 1.0 | 0.71 | 2.0 |

FIG. 39D

| AIP Number | Number of Expts | $EC_{50}$ (nM) | $EC_{50}$ Rank | ΔActivity (relative to AIP-160470) | ΔActivity Rank |
|---|---|---|---|---|---|
| AIP-157397 | 1 | 283 | 1.0 | 0.42 | 2.0 |
| AIP-161048 | 1 | 377 | 1.0 | 0.49 | 2.0 |
| AIP-163039 | 2 | 223 | 1.0 | 0.76 | 2.5 |
| AIP-165430 | 1 | 145 | 1.0 | 0.75 | 2.0 |
| AIP-166847 | 2 | 239 | 1.0 | 0.60 | 2.5 |
| AIP-167084 | 1 | 358 | 1.0 | 0.58 | 2.0 |
| AIP-167400 | 1 | 338 | 1.0 | 0.59 | 2.0 |
| AIP-167833 | 2 | 304 | 1.0 | 0.60 | 2.0 |
| AIP-171074 | 1 | 237 | 1.0 | 0.48 | 2.0 |
| AIP-171142 | 2 | 282 | 1.0 | 0.64 | 2.0 |
| AIP-171912 | 1 | 294 | 1.0 | 0.72 | 2.0 |
| AIP-172643 | 2 | 237 | 1.0 | 0.51 | 2.0 |
| AIP-173396 | 1 | 225 | 1.0 | 0.37 | 2.0 |
| AIP-182061 | 1 | 329 | 1.0 | 0.76 | 3.0 |
| AIP-182722 | 1 | 488 | 1.0 | 0.35 | 2.0 |
| AIP-184490 | 1 | 256 | 1.0 | 0.34 | 2.0 |
| AIP-190749 | 1 | 294 | 1.0 | 0.52 | 2.0 |
| AIP-192482 | 2 | 322 | 1.0 | 0.57 | 2.0 |
| AIP-196203 | 3 | 299 | 1.0 | 0.57 | 2.0 |
| AIP-100196 | 1 | >500 nM | 0.0 | 0.29 | 1.0 |
| AIP-105092 | 1 | >500 nM | 0.0 | 0.32 | 2.0 |
| AIP-106042 | 1 | >500 nM | 0.0 | 0.32 | 2.0 |
| AIP-109364 | 1 | >500 nM | 0.0 | 0.55 | 2.0 |
| AIP-115782 | 1 | >500 nM | 0.0 | 0.39 | 2.0 |
| AIP-123438 | 1 | >500 nM | 0.0 | 0.56 | 2.0 |
| AIP-124068 | 1 | >500 nM | 0.0 | 0.31 | 2.0 |
| AIP-124301 | 1 | >500 nM | 0.0 | 0.38 | 2.0 |
| AIP-126097 | 1 | >500 nM | 0.0 | 0.54 | 2.0 |
| AIP-129967 | 1 | >500 nM | 0.0 | 0.22 | 1.0 |
| AIP-132355 | 1 | >500 nM | 0.0 | 0.19 | 1.0 |
| AIP-135679 | 1 | >500 nM | 0.0 | 0.44 | 2.0 |
| AIP-138130 | 1 | >500 nM | 0.0 | 0.51 | 2.0 |
| AIP-139782 | 1 | >500 nM | 0.0 | 0.26 | 1.0 |
| AIP-140148 | 1 | >500 nM | 0.0 | 0.31 | 2.0 |
| AIP-141706 | 1 | >500 nM | 0.0 | 0.40 | 2.0 |
| AIP-144568 | 1 | >500 nM | 0.0 | 0.45 | 2.0 |
| AIP-145212 | 1 | >500 nM | 0.0 | 0.30 | 2.0 |
| AIP-147945 | 1 | >500 nM | 0.0 | 0.45 | 2.0 |
| AIP-148102 | 1 | >500 nM | 0.0 | 0.46 | 2.0 |
| AIP-148484 | 1 | >500 nM | 0.0 | 0.38 | 2.0 |
| AIP-149787 | 1 | >500 nM | 0.0 | 0.39 | 2.0 |
| AIP-150277 | 1 | >500 nM | 0.0 | 0.44 | 2.0 |
| AIP-151315 | 1 | >500 nM | 0.0 | 0.28 | 1.0 |
| AIP-151388 | 1 | >500 nM | 0.0 | 0.51 | 2.0 |

FIG. 39E

| AIP Number | Number of Expts | $EC_{50}$ (nM) | $EC_{50}$ Rank | ΔActivity (relative to AIP-160470) | ΔActivity Rank |
|---|---|---|---|---|---|
| AIP-152031 | 1 | >500 nM | 0.0 | 0.58 | 2.0 |
| AIP-155587 | 1 | >500 nM | 0.0 | 0.62 | 2.0 |
| AIP-156172 | 1 | >500 nM | 0.0 | 0.74 | 2.0 |
| AIP-163319 | 1 | >500 nM | 0.0 | 0.35 | 2.0 |
| AIP-165276 | 1 | >500 nM | 0.0 | 0.45 | 2.0 |
| AIP-166629 | 1 | >500 nM | 0.0 | 0.60 | 2.0 |
| AIP-167482 | 1 | >500 nM | 0.0 | 0.14 | 1.0 |
| AIP-169676 | 1 | >500 nM | 0.0 | 0.37 | 2.0 |
| AIP-170221 | 1 | >500 nM | 0.0 | 0.66 | 2.0 |
| AIP-171348 | 1 | >500 nM | 0.0 | 0.31 | 2.0 |
| AIP-171543 | 1 | >500 nM | 0.0 | 0.27 | 1.0 |
| AIP-177193 | 1 | >500 nM | 0.0 | 0.72 | 2.0 |
| AIP-178251 | 1 | >500 nM | 0.0 | 0.91 | 3.0 |
| AIP-180905 | 1 | >500 nM | 0.0 | 0.15 | 1.0 |
| AIP-181592 | 1 | >500 nM | 0.0 | 0.36 | 2.0 |
| AIP-182087 | 1 | >500 nM | 0.0 | 0.35 | 2.0 |
| AIP-186403 | 1 | >500 nM | 0.0 | 0.45 | 2.0 |
| AIP-188293 | 1 | >500 nM | 0.0 | 0.35 | 2.0 |
| AIP-189296 | 1 | >500 nM | 0.0 | 0.56 | 2.0 |
| AIP-191805 | 1 | >500 nM | 0.0 | 0.40 | 2.0 |
| AIP-193088 | 1 | >500 nM | 0.0 | 0.31 | 2.0 |
| AIP-193106 | 1 | >500 nM | 0.0 | 0.44 | 2.0 |
| AIP-197785 | 1 | >500 nM | 0.0 | 0.46 | 2.0 |
| AIP-198092 | 1 | >500 nM | 0.0 | 0.18 | 1.0 |
| AIP-199264 | 1 | >500 nM | 0.0 | 0.35 | 2.0 |
| AIP-199616 | 1 | >500 nM | 0.0 | 0.24 | 1.0 |

FIG. 39F

**AIP-160470 Variants Selected for *In-vivo* Study Round 1**

| Antibody ID | Group | Mutations | EC50 | EC50 Rank | dAct Rank |
|---|---|---|---|---|---|
| AIP-167533 | HCDR2 Combination | H53SA, H54VA , H55TD, H58EK , H59TQ | 52 nM | 2.5 | 2.0 |
| AIP-180675 | HCDR3 Mutation | H126YF | 17 nM | 3.5 | 2.5 |
| AIP-126080 | HCDR3 Combination | H121YN, H123SQ | 191 nM | 1.5 | 2.5 |
| AIP-186435 | HCDR3 Combination | H103CA, H117CV | 136 nM | 2.0 | 2.0 |
| AIP-161571 | HCDR3 Combination | H108SN, H113DE, H119GN | 122 nM | 1.5 | 2.0 |
| AIP-163039 | HCDR3 Combination | H102F, H105RL, H120QS | 223 nM | 1.0 | 2.5 |
| AIP-101235 | HCDR3 Combination | H106GS, H112HS, H118GN | 51 nM | 2.0 | 3.0 |
| AIP-172643 | HCDR3 Combination | H101ST, H110PL, H126YW | 237 nM | 1.0 | 2.0 |
| AIP-181246 | HCDR3 Combination | H127MV, H128DN, H129VI | 161 nM | 2.0 | 2.0 |
| AIP-192216 | HCDR3 Combination | H100ST, H107GA, H118GA, H120QS | 155 nM | 2.0 | 2.0 |
| AIP-112580 | HCDR3 Combination | H99TI, H107GN, H112HS, H118GN | 84 nM | 2.0 | 2.5 |
| AIP-170105 | LCDR1 Mutation | L35SY | 28 nM | 3.5 | 3.0 |
| AIP-136060 | LCDR2 Combination | L53NS, L54QL, L57SQ | 51 nM | 2.5 | 2.5 |
| AIP-172872 | CDR Combination | H59TQ, L53NT, L97SN | 98 nM | 2.0 | 2.0 |
| AIP-190051 | CDR Combination | H35ST, L26SP, L95SA | 43 nM | 2.5 | 3.0 |
| AIP-168605 | CDR Combination | L28ND, L93DN, L95SA | 71 nM | 2.0 | 2.0 |

FIG. 40

AIP-160470 Variants Selected for *In-vivo* Study Round 2

| Antibody ID | Group | Comments | EC50 | EC50 Rank | dAct Rank |
|---|---|---|---|---|---|
| AIP-101235 | HCDR3 Combination | TSSFCCRSGSCPSSDTSYCNGQYKSYYYMDV (3) | 51 nM | 2.0 | 3.0 |
| AIP-189473 | HCDR3 Combination | TTSFCCRGASCPSSDTSYCAGSYKSYYFVNI (9) | 85 nM | 2.0 | 2.5 |
| AIP-192571 | HCDR3 Combination | TSSFCCRGNQCPSSDTSYCGGQYPSYYYMDP (5) | 110 nM | 2.0 | 2.0 |
| AIP-125258 | HCDR3 Combination | ISSFCCRGKQCPSSDTSYCNGYYADYYFMDV (9) | 31 nM | 3.5 | 3.0 |
| AIP-150199 | HCDR3 Combination | ISSFCCRGKQCPSSDTSYCGGQFKSYYFMDV (6) | 26 nM | 3.5 | 3.0 |
| AIP-115388 | HCDR3 Combination | ISSFCCHSNNCPSSDTSYCNGYYKQYYFMDV (10) | 319 nM | 1.0 | 3.0 |
| AIP-143369 | CDR Combination | Mutations in H1, H2, L1, L2 (8) | 196 nM | 1.5 | 2.5 |
| AIP-157045 | CDR Combination | Mutations in H1, H2, L1, L2, L3 (9) | 21 nM | 4.0 | 3.0 |
| AIP-175775 | CDR Combination | Mutations in H1, H3, L1, L2, L3 (10) | 90 nM | 2.0 | 2.5 |
| AIP-154181 | CDR Combinatio n | Mutations in H1, H2, H3, L1, L2, L3 (9) | 46 nM | 3.0 | 2.0 |
| AIP-125984 | CDR Combination | Mutations in H1, H2, L1, L2, L3 (9) | 80 nM | 2.0 | 2.5 |
| AIP-160829 | CDR Combination | Mutations in H1, H2, H3, L1, L2, L3 (12) | 17 nM | 4.0 | 3.0 |
| AIP-184744 | CDR Combination | Mutations in H1, H2, H3, L1, L2, L3 (11) | 24 nM | 3.5 | 2.5 |
| AIP-127782 | Framework Swap | IGHV3-72, IGLV1-51 | 76 nM | 2.5 | 3.0 |
| AIP-128136 | Affinity Improvement | 8 mutations | 1 nM | 4.0 | 3.0 |
| AIP-181273 | Affinity Improvement | Subset A from AIP-128136 (4) | 9nM | 4.0 | 3.0 |
| AIP-153125 | Affinity Improvement | Subset B from AIP-128136 + L33SY (5) | 2 nM | 4.0 | 3.0 |

FIG. 41

Study Design

| Grp # | Test Art.1 | ATUM Order No. | Lot# | dose level (mg/kg) | Dose Freq. | n= | # of Doses | Route | MODEL |
|---|---|---|---|---|---|---|---|---|---|
| 1 | **AIP-127782** | 113823 | 2 | 5 | 2/Wk x 2 | 10 | 4 | *i.p.* | EMT6 |
| 2 | **AIP-189473** | 113823 | 2 | 5 | 2/Wk x 2 | 10 | 4 | *i.p.* | EMT6 |
| 3 | **AIP-192571** | 113823 | 2 | 5 | 2/Wk x 2 | 10 | 4 | *i.p.* | EMT6 |
| 4 | **AIP-125258** | 113823 | 2 | 5 | 2/Wk x 2 | 10 | 4 | *i.p.* | EMT6 |
| 5 | **AIP-150199** | 113823 | 2 | 5 | 2/Wk x 2 | 10 | 4 | *i.p.* | EMT6 |
| 6 | **AIP-115388** | 113823 | 2 | 5 | 2/Wk x 2 | 10 | 4 | *i.p.* | EMT6 |
| 7 | **AIP-143369** | 113823 | 2 | 5 | 2/Wk x 2 | 10 | 4 | *i.p.* | EMT6 |
| 8 | **AIP-157045** | 113823 | 2 | 5 | 2/Wk x 2 | 10 | 4 | *i.p.* | EMT6 |
| 9 | **AIP-175775** | 113823 | 2 | 5 | 2/Wk x 2 | 10 | 4 | *i.p.* | EMT6 |
| 10 | **AIP-154181** | 113823 | 2 | 5 | 2/Wk x 2 | 10 | 4 | *i.p.* | EMT6 |
| 11 | **AIP-125984** | 113823 | 2 | 5 | 2/Wk x 2 | 10 | 4 | *i.p.* | EMT6 |
| 12 | **AIP-160829** | 113823 | 2 | 5 | 2/Wk x 2 | 10 | 4 | *i.p.* | EMT6 |
| 13 | **AIP-184744** | 113823 | 2 | 5 | 2/Wk x 2 | 10 | 4 | *i.p.* | EMT6 |
| 14 | **AIP-128136** | 113823 | 2 | 5 | 2/Wk x 2 | 10 | 4 | *i.p.* | EMT6 |
| 15 | **AIP-181273** | 113823 | 2 | 5 | 2/Wk x 2 | 10 | 4 | *i.p.* | EMT6 |
| 16 | **AIP-153125** | 113823 | 2 | 5 | 2/Wk x 2 | 10 | 4 | *i.p.* | EMT6 |
| 17 | **AIP-101235** | 113823 | 3 | 5 | 2/Wk x 2 | 10 | 4 | *i.p.* | EMT6 |
| 18 | **AIP-192482** | 113823 | 60 | 5 | 2/Wk x 2 | 20 | 4 | *i.p.* | EMT6 |
| 19 | **AIP-160470** | 113823 | 56 | 5 | 2/Wk x 2 | 20 | 4 | *i.p.* | EMT6 |
| 20 | **PBS** | | | 0 | 2/Wk x 2 | 20 | 4 | *i.p.* | EMT6 |

Study Outline

- study tested 16 new variants + 1 (from round 1) + 2 in the EMT6 tumor model
- All antibodies tested at 5 mg/kg
- dosing plan was 2x/Wk for 4 doses

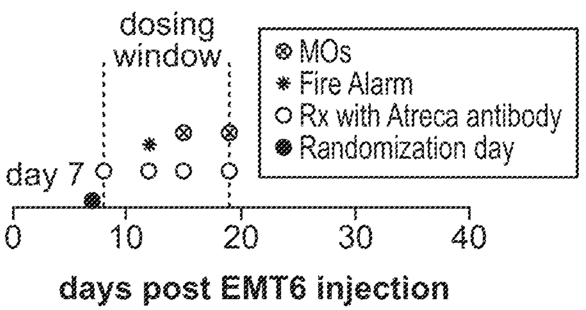

FIG. 42

Antibody Performance Metrics
antibodies sorted by median survival (days)

| Antibody ID | Median Survival | Log-Rank p-value | Ref. Median Survival |
|---|---|---|---|
| AIP-192571 | | 3.0E-05 | 28 |
| AIP-101235 | | 1.9E-02 | 28 |
| AIP-189473 | 40 | 2.6E-03 | 28 |
| AIP-125258 | 40 | 2.2E-03 | 28 |
| **AIP-160470** | 36 | 1.1E-02 | 28 |
| AIP-150199 | 34 | 2.7E-02 | 28 |
| AIP-157045 | 33.5 | 1.8E-02 | 28 |
| AIP-127782 | 30 | 7.5E-02 | 28 |
| AIP-181273 | 30 | 4.4E-02 | 28 |
| AIP-125984 | 28 | 5.5E-01 | 28 |
| AIP-128136 | 27 | 4.8E-01 | 28 |
| AIP-175775 | 27 | 2.7E-01 | 28 |
| **AIP-192482** | 26 | 2.1E-01 | 28 |
| AIP-115388 | 23 | 4.7E-01 | 28 |
| AIP-160829 | 19 | 9.5E-01 | 28 |
| AIP-143369 | 19 | 9.2E-01 | 28 |
| AIP-184744 | 19 | 9.1E-01 | 28 |
| AIP-153125 | 19 | 4.5E-01 | 28 |
| AIP-154181 | 19 | 4.4E-01 | 28 |

Antibodies with most efficacious response
antibodies sorted by NAAC effect size

| Antibody ID | n | NAAC effect size | NAAC p-value |
|---|---|---|---|
| AIP-181273 | 6 | 0.4500 | 6.9E-05 |
| AIP-101235 | 6 | 0.4384 | 9.9E-06 |
| **AIP-192571** | **9** | **0.4338** | **3.2E-07** |
| AIP-184744 | 2 | 0.4139 | 5.8E-03 |
| AIP-175775 | 4 | 0.4108 | 1.7E-04 |
| **AIP-160470** | 12 | 0.4104 | 1.9E-08 |
| AIP-153125 | 4 | 0.4032 | 1.2E-03 |
| AIP-127782 | 6 | 0.3921 | 6.9E-05 |
| AIP-143369 | 2 | 0.3513 | 5.8E-03 |
| AIP-157045 | 8 | .03268 | 7.4E-04 |
| AIP-189473 | 8 | 0.3152 | 3.7E-06 |
| AIP-125258 | 8 | 0.3150 | 6.5E-06 |
| AIP-150199 | 7 | 0.3108 | 5.5E-05 |
| AIP-154181 | 4 | 0.3043 | 3.3E-04 |
| AIP-115388 | 4 | 0.2806 | 6.7E-04 |
| AIP-160829 | 2 | 0.2775 | 3.5E-02 |
| **AIP-192482** | 10 | 0.2482 | 5.3E-06 |
| AIP-125984 | 5 | 0.1528 | 2.3E-03 |
| AIP-128136 | 6 | 0.1319 | 2.6E-02 |

Antibodies with most efficacious response antibodies sorted bt NGRM effect size

| Antibody ID | n | NGRM effect size | NGRM p-value |
|---|---|---|---|
| AIP-175775 | 4 | 0.5775 | 1.7E-04 |
| AIP-181273 | 6 | 0.5364 | 4.0E-05 |
| **AIP-192571** | 9 | 0.5229 | 3.2E-07 |
| AIP-127782 | 6 | 0.4436 | 3.0E-04 |
| AIP-101235 | 6 | 0.4433 | 9.9E-06 |
| AIP-143369 | 2 | 0.3187 | 5.8E-03 |
| AIP-154181 | 4 | 0.3142 | 6.7E-04 |
| AIP-157045 | 8 | 0.3051 | 7.9E-03 |
| **AIP-160470** | 12 | 0.2013 | 3.9E-08 |
| AIP-153125 | 4 | 0.1605 | 2.0E-03 |
| AIP-160829 | 2 | 0.1269 | 2.3E-02 |
| AIP-184744 | 2 | 0.1176 | 5.8E-03 |
| AIP-189473 | 8 | 0.1086 | 6.5E-06 |
| AIP-125258 | 8 | 0.0634 | 1.8E-05 |
| AIP-150199 | 7 | 0.0540 | 3.5E-05 |
| AIP-115388 | 4 | 0.0475 | 3.3E-04 |
| **AIP-192482** | 10 | 0.0396 | 5.3E-06 |
| AIP-125984 | 5 | 0.0196 | 5.7E-03 |
| AIP-128136 | 6 | 0.0115 | 1.1E-01 |

CR is when three consecutive TVMs are recorded as 0 mm^3.
(Analysis at day 40)

AIP-192482 IP Variants summary- Round 1 + Round 2

EFF-046

| Group | Mutations | Antibody ID | n | NAAC effect size | NGRM effect size |
|---|---|---|---|---|---|
| HCDR3 mutation | H106GS, H112HS, H118GN | AIP-101235 | 9 | 0.376 | 0.285 |
| - | Wildtype | AIP-160470 | 17 | 0.366 | 0.317 |
| Other CDRs | L28ND, L93DN, L95SA | AIP-168605 | 8 | 0.359 | 0.255 |
| Other CDRs | H108SN, H113DE, H119GN | AIP-161571 | 9 | 0.348 | 0.194 |
| Other CDRs | H35ST, L26SP, L95SA | AIP-190051 | 6 | 0.344 | 0.177 |
| Computational design of LCDR2 | L53NS, L54QL, L57SQ | AIP-136060 | 10 | 0.342 | 0.082 |

EFF-049

| Group | Mutations | Antibody ID | n | NAAC effect size | NGRM effect size |
|---|---|---|---|---|---|
| Affinity Improvement | Conservative set from AIP-128136 (4) | AIP-181273 | 6 | 0.450 | 0.536 |
| HCDR3 mutation | H106GS, H112HS, H118GN | AIP-101235 | 6 | 0.438 | 0.443 |
| HCDR3 Combination | TSSFCCRGNQCPSSDTSYCGGQYPSYYYMDP (5) | AIP-192571 | 9 | 0.434 | 0.523 |
| CDR Combination | Mutations in H1, H2, H3, L1, L2, L3 (11) | AIP-184744 | 2 | 0.414 | 0.118 |
| CDR Combination | Mutations in H1, H3, L1, L2, L3 (10) | AIP-175775 | 4 | 0.411 | 0.578 |
| - | Wildtype | AIP-160470 | 12 | 0.410 | 0.201 |

FIG. 49

ANTIBODIES THAT BIND TUMOR TISSUE FOR DIAGNOSIS AND THERAPY

CROSS-REFERENCE TO RELATED APPLICATIONS

This application claims priority benefit of U.S. Provisional Application No. 62/806,285 filed Feb. 15, 2019; U.S. Provisional Application No. 62/806,310, filed Feb. 15, 2019; U.S. Provisional Application No. 62/843,298, filed May 3, 2019; U.S. Provisional Application No. 62/843,751, filed May 6, 2019; U.S. Provisional Application No. 62/852,830, filed May 24, 2019; and U.S. Provisional Application No. 62/927,501, filed Oct. 29, 2019, each of which is incorporated by reference in their entirety for all purposes.

SEQUENCE LISTING

The instant application contains a Sequence Listing which has been submitted electronically in ASCII format and is hereby incorporated by reference in its entirety. Said ASCII copy, created on Mar. 31, 2020, is named 097519-1178152_(1860US)_SL.txt and is 980,578 bytes in size.

FIELD OF CANCER THERAPEUTICS

Therapeutic antibodies for the treatment of various cancers have had a dramatic impact on patient remission and survival. However, there continues to be a need for alternative oncology therapeutics, e.g., for treating patients who do not respond well to a therapy and/or become resistant to the therapy.

BRIEF SUMMARY

In one aspect, provided herein is an isolated antibody that binds to tumor tissues, wherein the antibody binds to an extracellular RNA-protein complex comprising polyadenylated RNA. In some embodiments, the extracellular RNA-protein complex further comprises rRNA. In some embodiments, the extracellular RNA-protein complex comprises mRNA. In some embodiments, the extracellular RNA-protein complex comprises one or more polyadenylated RNA binding proteins. In some embodiments, the extracellular RNA-protein complex further comprises a ribosomal protein. In some embodiments, the extracellular RNA-protein complex comprises an mRNA binding protein. In some embodiments, the extracellular RNA-protein complex comprises a poly(A)+ binding protein. In some embodiments, the extracellular RNA-protein complex comprises a polyadenylate binding protein family member. In some embodiments, the extracellular RNA-protein complex comprises a polyadenylate binding protein cytoplasmic (PABPC) family member. In some embodiments, the PABPC family member is PABPC 1 (PABPC1), PABPC 3 (PABPC3), or PABPC 4 (PABPC4). In some embodiments, the PABPC family member is PABPC1. In some embodiments, the extracellular RNA-protein complex comprises MOV10. In some embodiments, the extracellular RNA-protein complex comprises a biomolecular condensate. In some embodiments, the biomolecular condensate is induced by stress. In some embodiments, the biomolecular condensate is induced by hypoxia and/or a chemotherapeutic drug. In some embodiments, the antibody induces cellular signaling by binding to FcγRs. In some embodiments, the antibody comprises an Fc region that binds to FcγRIIa. In some embodiments, the antibody has an $EC_{50}$ of 500 nM or lower in an FcγRIIa engagement assay. In some embodiments, the FcγRIIa engagement assay employs EMT6 tumor cells passaged in vivo.

In an additional aspect, provided herein is an antibody that binds to an extracellular RNA-protein complex and wherein the antibody comprises:

(a) a heavy chain variable region comprising:

(i) an HCDR1 of any one of SEQ ID NOS:1-8 or 169-362, or a variant thereof in which 1, 2, 3, 4, or 5 amino acids are substituted relative to the sequence;

(ii) an HCDR2 of any one of SEQ ID NOS:9-19 or 363-556, or a variant thereof in which 1, 2, 3, 4, or 5 amino acids are substituted relative to the sequence; and (iii) an HCDR3 of any one of SEQ ID NOS:20-47, 557-750, or 1727 or a variant thereof in which 1, 2, 3, 4, 5, 6, 7, 8, 9, or 10 amino acids are substituted relative to the sequence;

(b) a light chain variable region comprising:

(i) an LCDR1 of any one of SEQ ID NOS:48-58 or 751-944 or 1741, or a variant thereof in which 1, 2, 3, 4, or 5 amino acids are substituted relative to the sequence;

(ii) an LCDR2 of any one of SEQ ID NOS:59-67 or 945-1138, or a variant thereof in which 1, 2, or 3 amino acids are substituted relative to the sequence; and (iii) an LCDR3 of any one of SEQ ID NOS:68-76 or 1139-1332, or a variant thereof in which 1, 2, 3, 4, or 5 amino acids are substituted relative to the sequence. In some embodiments, at least 1 or 2 of the substitutions are conservative substitutions; at least 50% of the substitutions are conservative substitutions; or all of the substitutions are conservative substitutions.

In some embodiments, the substitutions in each of the CDRs provides an HCDR1, HCDR2, HCDR3, LCDR1, LCDR2, LCDR3 comprising an amino acid sequence that complies with the following formula:

(a) an HCDR1 sequence G(F/Y)$X_3X_4$(A/S)$X_6$A(W/Y)$X_9$(S/T) (SEQ ID NO:1734), wherein $X_3$ is D, T or V; $X_4$ is A, F, or Y; $X_6$ is A, H, K, M, N or R; and $X_9$ is F, M, or Y;

(b) an HCDR2 sequence (F/R)I(K/Q)(A/S)$X_5X_6X_7$(A/G)$X_9X_{10}$T(D/E)(A/S)(P/S)(K/Q) (SEQ ID NO:1735), wherein $X_5$ is A, N, T, or V; $X_6$ is D, H, Q, S or T; $X_7$ is D, E, or N; $X_9$ is E, G, H, K or Q; and $X_{10}$ is A, I, Q or T; and (c) an HCDR3 sequence (I/T)(S/T)$X_3$(F/Y)$X_5$C$X_7$(G/S)$X_9X_{10}$C$X_{12}X_{13}X_{14}$(D/E)$X_{16}$S$X_{18}X_{19}X_{20}X_{21}X_{22}X_{23}X_{24}X_{25}$(F/Y) (F/Y)$X_{28}X_{29}$(D/N)$X_{31}$ (SEQ ID NO:1736), wherein $X_3$ is A, P, S, or T; $X_5$ is A, C, or S; $X_7$ is H, L, Q, or R; $X_9$ is A, G, K, or N; $X_{10}$ is A, N, Q, R, or S; $X_{12}$ is A, L, or P; $X_{13}$ is A, N, or S; $X_{14}$ is H, Q, R, or S; $X_{16}$ is N, Q, or T; $X_{18}$ is F, M, or Y; $X_{19}$ is C, S, or V; $X_{20}$ is A, G, or N; $X_{21}$ is A, G, or N; $X_{22}$ is Q, S, or Y; $X_{23}$ is D, F, N, S, or Y; $X_{24}$ is A, K, N, P, Q, or S; $X_{25}$ is D, K, Q, R, or S; $X_{28}$ is F, L, W, or Y; $X_{29}$ is F, M, or V; and $X_{31}$ is I, P, or V;

(d) an LCDR1 sequence $X_1$G(A/S)$X_4$(S/T)(D/N)I(G/Q)(H/S)$X_{10}X_{11}$(TN)$X_{13}$ (SEQ ID NO:1737), wherein $X_1$ is H, S, or T; $X_4$ is E, K, P, or S; $X_{10}$ is A, H, N, S, or T; $X_{11}$ is A, D, S, T, or Y; and $X_{13}$ is A, L, S, T or Y;

(e) an LCDR2 sequence $X_1$(D/N)$X_3X_4$(Q/R)(A/P)$X_7$ (SEQ ID NO:1738), wherein $X_1$ is A, H, K, M, N, or R; $X_3$ is N, S, or T; $X_4$ is A, L, Q, or Y; and $X_7$ is L, Q, S, or Y; and (f) an LCDR3 sequence (A/S)(S/T)(F/W)(D/N)$X_5X_6X_7X_8$(I/V)$X_{10}$(I/V) (SEQ ID NO:1739), wherein $X_5$ is D, E, or N; $X_6$ is A, D, Q, or S; $X_7$ is L, N, or S; $X_8$ is L, N, S, or T; and $X_{10}$ is H, K, Q, R, or W.

In some embodiments, the antibody comprises a $V_H$ region that comprises an HCDR1 comprising a sequence of any one of SEQ ID NOS:1-8 or 169-362, an HCDR2 comprising a sequence of any one of SEQ ID NOS:9-19 or 363-556, an HCDR3 comprising a sequence of any one of SEQ ID NOS:20-47 or 557-750 or 1727; an LCDR1 comprising a sequence of any one of SEQ ID NOS:48-58 or 751-944 or 1741, an LCDR2 comprising a sequence of any one of SEQ ID NOS:59-67 or 945-1138, and an LCDR3 comprising a sequence of any one of SEQ ID NOS:68-76 or 1139-1332, in which 1 or 2 amino acids are substituted in at least one of the HCDR1, HCDR2, HCDR3, LCDR1, LCDR2, and LCDR3.

In some embodiments, the antibody comprises a $V_H$ region comprising an HCDR1, HCDR2, and HCDR3 of a $V_H$ region of any one of SEQ ID NOS:77-122 or 1333-1526 or 1725; or a $V_L$ region comprising an LCDR1, LCDR2, LCDR3 of any one of SEQ ID NOS:123-168 or 1527-1720 or 1726.

In some embodiments, the antibody comprises a $V_H$ region comprising the HCDR1, the HCDR2, and the HCDR3 of an antibody set forth in a $V_H$ region of any one of SEQ ID NOS:77-122 and 1333-1526 or 1725; and a $V_L$ region comprising the LCDR1, LCDR2, and LCDR3 of the corresponding light chain of any one of SEQ ID NOS:123-168 or 1527-1720 or 1726. In some embodiments, the substitutions in each of the CDRs provides a HCDR1, HCDR2, HCDR3, LCDR1, LCDR2, LCDR3 comprising an amino acid sequence that complies with the following formula:

(a) an HCDR1 sequence G(F/Y)$X_3X_4$(A/S)$X_6$A(W/Y)(F/M)(S/T) (SEQ ID NO: 1742), wherein $X_3$ is D, T or V; $X_4$ is A, F, or Y; and $X_6$ is A, H, K, M, or N;

(b) an HCDR2 sequence RIK(A/S)$X_5X_6$(D/N)(A/G)$X_9X_{10}$(D/E)(A/S)(P/S)(K/Q) (SEQ ID NO: 1743), wherein $X_5$ is A, N, T, or V; $X_6$ is D, H, Q, S or T; $X_9$ is E, G, H, K or Q; and $X_{10}$ is A, I, Q, or T;

(c) an HCDR3 sequence (I/T)(S/T)$X_3$(F/Y)CC$X_7$(G/S)$X_9X_{10}$C$X_{12}$(N/S)$X_{14}$(D/E)TS(F/Y)C$X_{20}$(G/N)$X_{22}X_{23}X_{24}$, $X_{25}$(F/Y)Y$X_{28}X_{29}$(D/N)$X_{31}$ (SEQ ID NO: 1744), wherein $X_3$ is A, P, or S; $X_7$ is H, L, Q, or R; $X_9$ is A, G, K, or N; $X_{10}$ is A, N, Q, R, or S; $X_{12}$ is A, L, or P; $X_{14}$ is H, Q, R, or S; $X_{20}$ is A, G, or N; $X_{22}$ is Q, S, or Y; $X_{23}$ is D, F, N, or Y; $X_{24}$ is A, K, N, P, or Q; $X_{25}$ is D, Q, R, or S; $X_{28}$ is F, L, W, or Y; $X_{29}$ is F, M, or V; and $X_{31}$ is I, P, or V;

(d) an LCDR1 sequence (S/T)G(A/S)$X_4$(S/T)(D/N)IG(H/S)$X_{10}X_{11}$(TN)$X_{13}$ (SEQ ID NO: 1745), wherein $X_4$ is K, P, or S, $X_{10}$ is A, N, S, or T; $X_{11}$ is A, S, T, or Y; and $X_{13}$ is A, S, T or Y;

(e) an LCDR2 sequence $X_1$(D/N)$X_3X_4$(Q/R)(A/P)$X_7$ (SEQ ID NO: 1738), wherein $X_1$ is A, H, K, M, N, or R; $X_3$ is N, S, or T; $X_4$ is A, L, Q, or Y, and $X_7$ is L, Q, S, or Y; and (f) an LCDR3 sequence (A/S)(S/T)W(D/N)$X_5X_6X_7X_8$(I/V)$X_{10}$(I/V) (SEQ ID NO: 1746), wherein $X_5$ is D, E, or N, $X_6$ is A, D, Q, or S, $X_7$ is L, N, or S; $X_8$ is L, N, S, or T; and $X_{10}$ is H, K, Q, or R.

In some embodiments, the antibody comprises an HCDR1, HCDR2, HCDR3, LCDR1, LCDR2, and LCDR3 of an antibody designated as AIP-192482, AIP-171142, AIP-165430, AIP-189526, AIP-122563, AIP-158623, AIP-155066, AIP-166120, AIP-133645, AIP-187893, AIP-142079, AIP-160470, AIP-102396, AIP-150055, AIP-167084, AIP-185304, AIP-134770, AIP-141887, AIP-196203, AIP-128195, AIP-116579, AIP-192329, AIP-197809, AIP-142489, AIP-167726, AIP-199834, AIP-143179, AIP-195587, AIP-153462, AIP-115363, AIP-151090, AIP-168083, AIP-161082, AIP-114196, AIP-189338, AIP-183190, AIP-110143, AIP-147176, AIP-134312, AIP-128243, AIP-156172, AIP-147389, AIP-124314, AIP-185291, AIP-135247, AIP-113513, AIP-102299, AIP-179097, AIP-109343, AIP-119622, AIP-191735, AIP-157078, AIP-153475, AIP-133650, AIP-190915, AIP-167400, AIP-109729, AIP-151709, AIP-136628, AIP-101601, AIP-146871, AIP-170053, AIP-199483, AIP-162041, AIP-180675, AIP-183133, AIP-191470, AIP-151167, AIP-106633, AIP-102624, AIP-109484, AIP-126080, AIP-161571, AIP-163039, AIP-101235, AIP-182061, AIP-181246, AIP-192216, AIP-171912, AIP-172872, AIP-167833, AIP-190051, AIP-145518, AIP-167533, AIP-112580, AIP-143155, AIP-119664, AIP-190526, AIP-114403, AIP-156760, AIP-103803, AIP-195588, AIP-145722, AIP-178251, AIP-116142, AIP-183350, AIP-127108, AIP-128147, AIP-109510, AIP-104086, AIP-143132, AIP-170105, AIP-169636, AIP-152243, AIP-138776, AIP-103817, AIP-130491, AIP-188155, AIP-167246, AIP-106139, AIP-198351, AIP-159326, AIP-192275, AIP-190761, AIP-166832, AIP-148062, AIP-129145, AIP-111240, AIP-153888, AIP-130915, AIP-109048, AIP-170569, AIP-154873, AIP-159037, AIP-186826, AIP-156514, AIP-157122, AIP-173276, AIP-150485, AIP-166847, AIP-124013, AIP-126285, AIP-168605, AIP-190274, AIP-136060, AIP-180422, AIP-166722, AIP-127782, AIP-189473, AIP-192571, AIP-112328, AIP-125258, AIP-150199, AIP-125062, AIP-177193, AIP-115388, AIP-107759, AIP-170221, AIP-143369, AIP-189475, AIP-102833, AIP-157045, AIP-175775, AIP-154181, AIP-125984, AIP-160829, AIP-184744, AIP-128136, AIP-181273, AIP-153125, or AIP-131972 in Table Table 1A or Table 2A, or a variant thereof in which at least one, two, three, four, five, or all six of the CDRs contain 1 or 2 amino acid substitutions compared to the corresponding CDR sequence shown in Table 1B or Table 2B.

In some embodiments, the antibody comprises an HCDR1, HCDR2, HCDR3, LCDR1, LCDR2, and LCDR3 of an antibody designated as AIP-192482, AIP-171142, AIP-165430, AIP-189526, AIP-122563, AIP-158623, AIP-155066, AIP-166120, AIP-133645, AIP-187893, AIP-142079, AIP-160470, AIP-102396, AIP-150055, AIP-167084, AIP-185304, AIP-134770, AIP-141887, AIP-196203, AIP-128195, AIP-116579, AIP-192329, AIP-197809, AIP-142489, AIP-167726, AIP-199834, AIP-143179, AIP-195587, AIP-153462, AIP-115363, AIP-151090, AIP-168083, AIP-161082, AIP-114196, AIP-189338, AIP-183190, AIP-110143, AIP-147176, AIP-134312, AIP-128243, AIP-156172, AIP-147389, AIP-124314, AIP-185291, AIP-135247, AIP-113513, AIP-102299, AIP-179097, AIP-109343, AIP-119622, AIP-191735, AIP-157078, AIP-153475, AIP-133650, AIP-190915, AIP-167400, AIP-109729, AIP-151709, AIP-136628, AIP-101601, AIP-146871, AIP-170053, AIP-199483, AIP-162041, AIP-180675, AIP-183133, AIP-191470, AIP-151167, AIP-106633, AIP-102624, AIP-109484, AIP-126080, AIP-161571, AIP-163039, AIP-101235, AIP-182061, AIP-181246, AIP-192216, AIP-171912, AIP-172872, AIP-167833, AIP-190051, AIP-145518, AIP-167533, AIP-112580, AIP-143155, AIP-119664, AIP-190526, AIP-114403, AIP-156760, AIP-103803, AIP-195588, AIP-145722, AIP-178251, AIP-116142, AIP-183350, AIP-127108, AIP-128147, AIP-109510, AIP-104086, AIP-143132, AIP-170105, AIP-169636, AIP-152243, AIP-138776, AIP-103817, AIP-130491, AIP-188155, AIP-167246, AIP-106139, AIP-198351, AIP-159326, AIP-192275, AIP-190761, AIP-166832, AIP-148062, AIP-129145, AIP-111240, AIP-153888, AIP-130915, AIP-109048, AIP-170569, AIP-154873, AIP-159037, AIP-186826, AIP-156514, AIP-157122, AIP-173276, AIP-150485, AIP-166847, AIP-124013, AIP-126285, AIP-168605, AIP-190274, AIP- 136060, AIP-180422, AIP-166722, AIP-127782, AIP-189473, AIP-192571, AIP-112328, AIP-125258, AIP-150199, AIP-125062, AIP-177193, AIP-115388, AIP-107759, AIP-170221, AIP-143369, AIP-189475, AIP-102833, AIP-157045, AIP-175775, AIP-154181, AIP-125984, AIP-160829, AIP-184744, AIP-128136, AIP-181273, AIP-153125, or AIP-131972 in Table 1B or Table 2B.

In a further aspect, provided herein is an antibody that binds to an extracellular RNA-protein complex and wherein the antibody comprises:

(a) a heavy chain variable region comprising:

(i) an HCDR1 having the sequence GF(T/V)(F/Y)(S/A)$X_6$AWM(S/T) (SEQ ID NO:1728), wherein $X_6$ is K, A, or M;

(ii) an HCDR2 having the sequence of RIK(S/A)$X_5X_6$(D/E)(G/A)$X_9X_{10}$T(D/E)YAA(P/S)VKG (SEQ ID NO:1729), wherein $X_5$ is V, N, A, or T; $X_6$ is T, Q, S, D, or H; $X_9$ is E, H, K, or G; and $X_{10}$ is T, Q, or I; (iii) an HCDR3 having the sequence of (I/T)(S/T)SFCC(H/R)(G/S)$X_9X_{10}$CPS$X_{14}$(D/E)TS(F/Y)C$X_{20}$(G/N)$X_{22}X_{23}X_{24}X_{25}$ (F/Y)Y(F/Y)(M/V)(D/N)$X_{31}$ (SEQ ID NO:1730), wherein $X_9$ is A, G, K, or N; $X_{10}$ is N, Q, R, or S; $X_{14}$ is H, R, or S; $X_{20}$ is A, G, or N; $X_{22}$ is Q, S, or Y; $X_{23}$ is D, F, N, or Y; $X_{24}$ is A, K, N, P, or S; $X_{25}$ is D, Q, R, or S; and $X_{31}$ is I, P, or V;

(b) a light chain variable region comprising:

(i) an LCDR1 having the sequence of SG(S/A)$X_4$(S/T)(N/D)IGSS$X_{11}$V$X_{13}$ (SEQ ID NO:1731), wherein $X_4$ is S, P, or K; $X_{11}$ is S, Y, or T; and $X_{13}$ is S, Y, or T;

(ii) an LCDR2 having the sequence of (K/M)(N/D)$X_3X_4$R(P/A)$X_7$ (SEQ ID NO:1732), wherein $X_3$ is S, N or T; $X_4$ is L, Q, or A; $X_7$ is Q, S, Y, or L; and (iii) an LCDR3 having the sequence of (S/A)(T/S)W(D/N)$X_5X_6$(L/N)$X_5$(V/I)R(V/I) (SEQ ID NO:1733), wherein $X_5$ is E, D or N; $X_6$ is S, A, or Q; and $X_5$ is N, S or T. In some embodiments, in the HCDR1 sequence, position 3 is T; position 4 is F; position 5 is S; position 6 is K; and/or position 10 is S. In some embodiments, the HCDR1 sequence comprises a sequence GFTFSKAWMS (SEQ ID NO:1). In some embodiments, the HCDR1 comprises a sequence of any one of GFTFSAAWMS (SEQ ID NO:4), GFVFSKAWMS (SEQ ID NO:7), GFTFAKAWMS (SEQ ID NO:6), GFTYSKAWMS (SEQ ID NO:5), GFTFSMAWMS (SEQ ID NO:3), GFTYSAAWMS (SEQ ID NO:2), or GFTFSKAWMT (SEQ ID NO:8). In some embodiments, in the HCDR2 sequence, position 4 is S; position 5 is V; position 6 is T; position 7 is D; position 8 is G; position 9 is E; position 10 is T; position 12 is D; and/or position 16 is P. In some embodiments, the HCDR2 comprises a sequence RIKSVTDGETTDYAAPVKG (SEQ ID NO:9). In some embodiments, the HCDR2 comprises a sequence RIKSVTDGEQTDYAAPVKG (SEQ ID NO:18), RIKAADDGKQTDYAAPVKG (SEQ ID NO:19), RIKSVTDGETTEYAASVKG (SEQ ID NO: 504), RIKAVHDGETTDYAAPVKG (SEQ ID NO:10), RIKSNTDAETTDYAAPVKG (SEQ ID NO:11), RIKSVQDGETTDYAAPVKG (SEQ ID NO:12), RIKSVTDGHTTDYAAPVKG (SEQ ID NO:13), RIKSVTDGGITDYAAPVKG (SEQ ID NO:14), RIKSTSDGETTDYAAPVKG (SEQ ID NO:15), RIKSTSDGGITDYAAPVKG (SEQ ID NO:16), or RIKSVTEGETTDYAAPVKG (SEQ ID NO:17). In some embodiments, in the HCDR3 sequence, position 1 is T; position 2 is S; position 7 is R; position 8 is G; position 9 is G; position 10 is S; position 14 is H; position 15 is D; position 18 is Y; position 20 is G; and/or position 21 is G. In some embodiments, the HCDR3 comprises a sequence TSSFCCRGGSCPSHDTSYCGGYYKSYYYMDV (SEQ ID NO:33), TSSFCCRGGSCPSHDTSYCGGQYKSYYYMDV (SEQ ID NO:21), or TSSFCCRGGSCPSHDTSYCGGQYKSFYYMDV (SEQ ID NO:28). In some embodiments, the HCDR3 comprises a sequence: TSSFCCRGGSCPSSDTSYCGGQYKSYYFMDV (SEQ ID NO:32), ISSFCCRGGSCPSRDTSYCGGQYKSYYFMDV (SEQ ID NO:30), ISSFCCRGNSCPSSDTSYCNGQYKSYYFMDV (SEQ ID NO:29), ISSFCCRGNSCPSSDTSYCNGQYKSYYYMDV (SEQ ID NO:27), ISSFCCHSNNCPSSDTSYCNGYYKQYYFMDV (SEQ ID NO:26), ISSFCCRGKQCPSSDTSYCGGQFKSYYFMDV (SEQ ID NO:25), ISSFCCRGKQCPSSDTSYCNGYYADYYFMDV (SEQ ID NO:24), TSSFCCRGNQCPSSDTSYCGGQYPSYYYMDP (SEQ ID NO:23), TTSFCCRGASCPSSDTSYCAGSYKSYYFVNI (SEQ ID NO:22), TSSFCCRSGSCPSSDTSYCNGQYKSYYYMDV (SEQ ID NO:20), TSSFCCRGGSCPSHDTSYCGGQDSRYYYMDV (SEQ ID NO:42), TSSFCCRGGSCPSHDTSFCGGSYKSYYYMDV (SEQ ID NO:41), TSSFCCRGGSCPSHDTSFCGGQYKSYYYMDV (SEQ ID NO:37), TSSFCCRGGSCPSHDTSFCGGQDSRYYYMDV (SEQ ID NO:40), TTSFCCRGGSCPSHDTSFCGGQYKSYYYMDV (SEQ ID NO:39), TSSFCCRGGSCPSHDTSFCGGQDKRYYYMDV (SEQ ID NO:34), TTSFCCRGGRCPSRDTSFCGGQYNSYYYMDV (SEQ ID NO:38), TSSFCCRGGSCPSHDTSFCGGQYNRYYYMDV (SEQ ID NO:36), and TTSFCCRGGSCPSHDTSFCGGQDKRYYYMDV (SEQ ID NO:35). In some embodiments, in the LCDR1 sequence, position 3 is S; position 4 is S; position 5 is S; position 6 is N; position 11 is S; and/or position 13 is S. In some embodiments, the LCDR1 comprises a sequence SGSSSNIGSSSVS (SEQ ID NO:48). In some embodiments, the LCDR1 comprises the sequence SGSKSNIGSSYVS (SEQ ID NO:50), SGSSSNIGSSSVY (SEQ ID NO:56), SGSKSNIGSSSVY (SEQ ID NO:55), SGSSTNIGSSSVS (SEQ ID NO:54), SGASSNIGSSSVS (SEQ ID NO:52), SGSSTNIGSSTVS (SEQ ID NO:53), SGSKSNIGSSSVS (SEQ ID NO:51), or SGSSTNIGSSSVT (SEQ ID NO:49). In some embodiments, in the LCDR2 sequence, position 1 is K; position 2 is N; position 3 is N; position 4 is Q; position 6 is P; and/or position 7 is S. In some embodiments, the LCDR2 sequence comprises a sequence KNNQRPS (SEQ ID NO:59). In some embodiments, the LCDR2 comprises a sequence KNNQRPY (SEQ ID NO:66), KDNQRPS (SEQ ID NO:62), KNTQRPS (SEQ ID NO:65), KNNARPY (SEQ ID NO:64), KNTQRAS (SEQ ID NO:63), MNNQRPY (SEQ ID NO:61), or KDNQRPL (SEQ ID NO:60). In some embodiments, in the LCDR3 sequence, position 1 is S; position 2 is T; position 4 is D; position 5 is D; position 6 is S; position 7 is L; position 8 is S; position 9 is V; and/or position 11 is V. In some embodiments, the LCDR3 sequence comprises a sequence STWDDSLSVRV (SEQ ID NO:68). In some embodiments, the LCDR3 sequence comprises a sequence STWDDALSVRV (SEQ ID NO:72), SSWDDSNSVRI (SEQ ID NO:71), ATWDDQLSVRV (SEQ ID NO:69), ATWDDSLTVRI (SEQ ID NO:76), ATWDNSLSIRV (SEQ ID NO:70), or STWDESLSVRV (SEQ ID NO:73).

In some embodiments, the HCDR1 has a sequence GFTFSKAWMS (SEQ ID NO:1), GFTFSAAWMS (SEQ ID NO:4), or GFTFSKAWMT (SEQ ID NO:8); the HCDR2 has a sequence RIKSVTDGETTDYAAPVKG (SEQ ID NO:9) or RIKSTSDGETTDYAAPVKG (SEQ ID NO:15); the HCDR3 has a sequence TSSFC-CRGGSCPSSDTSYCGGQYKSYYFMDV (SEQ ID NO:32), TSSFCCRSGSCPSSDTSYCNGQYKSYYYMDV (SEQ ID NO:20), TSSFC-CRGNQCPSSDTSYCGGQYPSYYYMDP (SEQ ID NO:23), ISSFCCRGGSCPSRDTSYCGGQYKSYYFMDV (SEQ ID NO:30), ISSFCCRGN-SCPSSDTSYCNGQYKSYYYMDV (SEQ ID NO:27), TSSFCCRGGSCPSHDTSYCGGQYKSYYYMDV (SEQ ID NO:21), or TSSFCCRGGSCP-SHDTSFCGGQDKRYYYMDV (SEQ ID NO:34);

the LCDR1 has a sequence SGSSSNIGSSSVY (SEQ ID NO:56), SGSSSNIGSSSVS (SEQ ID NO:48), SGSST-NIGSSSVS (SEQ ID NO:54), or SGSKSNIGSSSVS (SEQ ID NO:51); the LCDR2 has a sequence KNNQRPS (SEQ ID NO:59) or KDNQRPS (SEQ ID NO:62); and the LCDR3 has a sequence STWDDALSVRV (SEQ ID NO:72), STWDDSLSVRV (SEQ ID NO:68), SSWDDSNS-VRI (SEQ ID NO:71), or ATWDNSLSIRV (SEQ ID NO:70)

In some embodiments, the heavy chain variable region has a sequence having at least 90% identity to the sequence of any one of EVQLVESGGALVKPGGSLRLS-CAASGFTFSKAWMSWVRQAPGKGLEWVGRIKSVT DGETTDYAAPVKGRFTISRDDSKSTLYLQMNSLKT-EDTAVYYCTSSFCCRGGSCPSS DTSYCGGQYKSYYFMDVWGKGTTVTVSS (SEQ ID NO:92), EVQLVESGGALVKPGGSLRLS-CAASGFTFSKAWMSWVRQAPGKGLEWVGRIKSVT DGETTDYAAPVKGRFTISRDDSKSTLYLQMNSLKT-EDTAVYYCTSSFCCRSGSCPSS DTSYCNGQYKSYYYMDVWGKGTTVTVSS (SEQ ID NO:77), EVQLVESGGALVKPGGSLRLS-CAASGFTFSKAWMSWVRQAPGKGLEWVGRIKSVT DGETTDYAAPVKGRFTISRDDSKSTLYLQMNSLKT-EDTAVYYCTSSFCCRGNQCPSS DTSYCGGQYPSYYYMDPWGKGTTVTVSS (SEQ ID NO:80), EVQLVESGGALVKPGGSLRLS-CAASGFTFSAAWMSWVRQAPGKGLEWVGRIKSTSD GETTDYAAPVKGRFTISRDDSKSTLYLQMNSLKTED-TAVYYCISSFCCRGGSCPSRDT SYCGGQYKSYYFMDVWGKGTTVTVSS (SEQ ID NO:90), EVQLVESGGALVKPGGSLRLS-CAASGFTFSAAWMSWVRQAPGKGLEWVGRIKSVT DGETTDYAAPVKGRFTISRDDSKSTLYLQMNSLKT-EDTAVYYCISSFCCRGNSCPSSD TSYCNGQYKSYYYMDVWGKGTTVTVSS (SEQ ID NO:86), EVQLVESGGALVKPGGSLRLS-CAASGFTFSKAWMSWVRQAPGKGLEWVGRIKSVT DGETTDYAAPVKGRFTISRDDSKSTLYLQMNSLKT-EDTAVYYCTSSFCCRGGSCPSH DTSYCGGQYKSYYYMDVWGKGTTVTVSS (SEQ ID NO:94), and EVQLVESGGALVKPGGSLRLS-CAASGFTFSKAWMTWVRQAPGKGLEWVGRIKSVT DGETTDYAAPVKGRFTISRDDSKSVLYLQMSSLKT-EDTAVYFCTSSFCCRGGSCPSH DTSFCGGQDKRYYYMDVWGKGTTVTVSS (SEQ ID NO:95). In some embodiments, which may be combined with the preceding the light chain variable region has a sequence having at least 90% identity to the sequence of any one of (SEQ ID NO: 138)
QSVLTQPPSASGTPGQRVTISCSGSSSNIGSSSVYWYQQLPGTAPKLLIY
KNNQRPSGVPDRFSGSKSGTSASLAISGLRSEDEADYYCSTWDDALSVRV
FGGGTKLTVL, (SEQ ID NO: 140)
QSVLTQPPSASGTPGQRVTISCSGSSSNIGSSSVSWYQQLPGTAPKLLIY
KNNQRPSGVPDRFSGSKSGTSASLAISGLRSEDEADYYCSTWDDSLSVRV
FGGGTKLTVL, (SEQ ID NO: 136)
QSVLTQPPSASGTPGQRVTISCSGSSTNIGSSSVSWYQQLPGTAPKLLIY
KDNQRPSGVPDRFSGSKSGTSASLAISGLRSEDEADYYCSSWDDSNSVRI
FGGGTKLTVL, (SEQ ID NO: 132)
QSVLTQPPSASGTPGQRVTISCSGSKSNIGSSSVSWYQQLPGTAPKLLIY
KDNQRPSGVPDRFSGSKSGTSASLAISGLRSEDEADYYCATWDNSLSIRV
FGGGTKLTVL,
and (SEQ ID NO: 141)
QSVLTQAPSASETPGQRVIISCSGSSSNIGSSSVSWYQQLPGTAPKLLIY
KNNQRPSGVPDRFSGSKSGTSASLAISGLRSEDEADYYCSTWDDSLSVRV
FGGGTKLTVL.

In some embodiments, the antibody comprises an HCDR1 having a sequence GFTFSKAWMS (SEQ ID NO:1); an HCDR2 having a sequence RIKSVTDGETTDYAAPVKG (SEQ ID NO:9); an HCDR3 having a sequence TSSFC-CRGGSCPSSDTSYCGGQYKSYYFMDV (SEQ ID NO:32); an LCDR1 having a sequence SGSSSNIGSSSVY (SEQ ID NO:56); an LCDR2 having a sequence KNNQRPS (SEQ ID NO:59); and an LCDR3 having a sequence STWD-DALSVRV (SEQ ID NO:72). In some embodiments, the heavy chain variable region has a sequence having at least 90% identity to the sequence of EVQLVESG-GALVKPGGSLRLSCAASGFTFSKAWMSWVRQAPGK-GLEWVGRIKSVT DGETTDYAAPVKGRFTISRDDSK-STLYLQMNSLKTEDTAVYYCTSSFCCRGGSCPSS DTSYCGGQYKSYYFMDVWGKGTTVTVSS (SEQ ID NO:92); and the light chain variable region has a sequence having at least 90% identity to the sequence of QSVLTQPP-SASGTPGQRVTISCSGSSSNIGSSSVYWYQQLPGT-APKLLIYKNNQRPSG VPDRFSGSKSGTSASLAIS-GLRSEDEADYYCSTWDDALSVRVFGGGTKLTVL (SEQ ID NO:138). In some embodiments, the heavy chain variable region comprises a sequence EVQLVESG-GALVKPGGSLRLSCAASGFTFSKAWMSWVRQAPGK-GLEWVGRIKSVT DGETTDYAAPVKGRFTISRDDSK-STLYLQMNSLKTEDTAVYYCTSSFCCRGGSCPSS DTSYCGGQYKSYYFMDVWGKGTTVTVSS (SEQ ID NO:92); and the light chain variable region comprises a sequence (SEQ ID NO: 138)
QSVLTQPPSASGTPGQRVTISCSGSSSNIGSSSVYWYQQLPGTAPKLLIY
KNNQRPSGVPDRFSGSKSGTSASLAISGLRSEDEADYYCSTWDDSLSVRV
FGGGTKLTVL.

In some embodiments, the HCDR1 has a sequence GFTFSKAWMS (SEQ ID NO:1); the HCDR2 has a sequence RIKSVTDGETTDYAAPVKG (SEQ ID NO:9);

the HCDR3 has a sequence of TSSFCCRSGSCPSSDTSYCNGQYKSYYYMDV (SEQ ID NO:20); the LCDR1 has a sequence SGSSSNIGSSSVS (SEQ ID NO:48); the LCDR2 has a sequence KNNQRPS (SEQ ID NO:59); and the LCDR3 has a sequence STWDDSLSVRV (SEQ ID NO:68). In some emboidments, the heavy chain variable region has a sequence having at least 90% identity to the sequence of EVQLVESGGALVKPGGSLRLSCAASGFTFSKAWMSWVRQAPGKGLEWVGRIKSVT DGETTDYAAPVKGRFTISRDDSKSTLYLQMNSLKTEDTAVYYCTSSFCCRSGSCPSS DTSYCNGQYKSYYYMDVWGKGTTVTVSS (SEQ ID NO:77); and the light chain variable region has a sequence having at least 90% identity to the sequence of (SEQ ID NO: 140)
QSVLTQPPSASGTPGQRVTISCSGSSSNIGSSSVSWYQQLPGTAPKLLIYK
NNQRPSGVPDRFSGSKSGTSASLAISGLRSEDEADYYCSTWDDSLSVRVFG
GGTKLTVL.

In some embodiments, the heavy chain variable region comprises a sequence EVQLVESGGALVKPGGSLRLSCAASGFTFSKAWMSWVRQAPGKGLEWVGRIKSVT DGETTDYAAPVKGRFTISRDDSKSTLYLQMNSLKTEDTAVYYCTSSFCCRSGSCPSS DTSYCNGQYKSYYYMDVWGKGTTVTVSS (SEQ ID NO:77); and the light chain variable region comprises a sequence (SEQ ID NO: 140)
QSVLTQPPSASGTPGQRVTISCSGSSSNIGSSSVSWYQQLPGTAPKLLIYK
NNQRPSGVPDRFSGSKSGTSASLAISGLRSEDEADYYCSTWDDSLSVRVFG
GGTKLTVL In some embodiments, the HCDR1 has a sequence GFTFSKAWMS (SEQ ID NO:1); the HCDR2 has a sequence RIKSVTDGETTDYAAPVKG (SEQ ID NO:9); the HCDR3 has a sequence TSSFCCRGNQCPSSDTSYCGGQYPSYYYMDP (SEQ ID NO:23); the LCDR1 has a sequence SGSSSNIGSSSVS (SEQ ID NO:48); the LCDR2 has a sequence KNNQRPS (SEQ ID NO:59); and the LCDR3 has a sequence STWDDSLSVRV (SEQ ID NO:68).

In some embodiments, the heavy chain variable region has a sequence having at least 90% identity to the sequence of EVQLVESGGALVKPGGSLRLSCAASGFTFSKAWMSWVRQAPGKGLEWVGRIKSVT DGETTDYAAPVKGRFTISRDDSKSTLYLQMNSLKTEDTAVYYCTSSFCCRGNQCPSS DTSYCGGQYPSYYYMDPWGKGTTVTVSS (SEQ ID NO:80); and the light chain variable region has a sequence having at least 90% identity to the sequence of (SEQ ID NO: 140)
QSVLTQPPSASGTPGQRVTISCSGSSSNIGSSSVSWYQQLPGTAPKLLIYK
NNQRPSGVPDRFSGSKSGTSASLAISGLRSEDEADYYCSTWDDSLSVRVFG
GGTKLTVL.

In some embodiments, the heavy chain variable region comprises a sequence EVQLVESGGALVKPGGSLRLSCAASGFTFSKAWMSWVRQAPGKGLEWVGRIKSVT DGETTDYAAPVKGRFTISRDDSKSTLYLQMNSLKTEDTAVYYCTSSFCCRGNQCPSS DTSYCGGQYPSYYYMDPWGKGTTVTVSS (SEQ ID NO:80); and the light chain variable region comprises a sequence (SEQ ID NO: 140)
QSVLTQPPSASGTPGQRVTISCSGSSSNIGSSSVSWYQQLPGTAPKLLIYK
NNQRPSGVPDRFSGSKSGTSASLAISGLRSEDEADYYCSTWDDSLSVRVFG
GGTKLTVL.

In some embodiments, the HCDR1 has a sequence GFTFSAAWMS (SEQ ID NO:4); the HCDR2 has a sequence RIKSTSDGETTDYAAPVKG (SEQ ID NO:15); the HCDR3 has a sequence ISSFCCRGGSCPSRDTSYCGGQYKSYYFMDV (SEQ ID NO:30); the LCDR1 has a sequence SGSSTNIGSSSVS (SEQ ID NO:54); the LCDR2 has a sequence KDNQRPS (SEQ ID NO:62); and the LCDR3 has a sequence SSWDDSNSVRI (SEQ ID NO:71).

In some embodiments, the heavy chain variable region has a sequence having at least 90% identity to the sequence of EVQLVESGGALVKPGGSLRLSCAASGFTFSAAWMSWVRQAPGKGLEWVGRIKSTSD GETTDYAAPVKGRFTISRDDSKSTLYLQMNSLKTEDTAVYYCISSFCCRGGSCPSRDT SYCGGQYKSYYFMDVWGKGTTVTVSS (SEQ ID NO:90); andthe light chain variable region has a sequence having at least 90% identity to the sequence of QSVLTQPPSASGTPGQRVTISCSGSSTNIGSSSVSWYQQLPGTAPKLLIYKDNQRPSGV PDRFSGSKSGTSASLAISGLRSEDEADYYCSSWDDSNSVRIFGGGTKLTVL (SEQ ID NO:136).

In some embodiments, the heavy chain variable region comprises a sequence EVQLVESGGALVKPGGSLRLSCAASGFTFSAAWMSWVRQAPGKGLEWVGRIKSTSD GETTDYAAPVKGRFTISRDDSKSTLYLQMNSLKTEDTAVYYCISSFCCRGGSCPSRDT SYCGGQYKSYYFMDVWGKGTTVTVSS (SEQ ID NO:90); and the light chain variable region comprises a sequence (SEQ ID NO: 136)
QSVLTQPPSASGTPGQRVTISCSGSSTNIGSSSVSWYQQLPGTAPKLLIYK
DNQRPSGVPDRFSGSKSGTSASLAISGLRSEDEADYYCSSWDDSNSVRIFG
GGTKLTVL.

In some embodiments, the antibody has an HCDR1 sequence GFTFSAAWMS (SEQ ID NO:4); an HCDR2 sequence RIKSVTDGETTDYAAPVKG (SEQ ID NO:9); an HCDR3 sequence ISSFCCRGNSCPSSDTSYCNGQYKSYYYMDV (SEQ ID NO:27); an LCDR1 sequence SGSKSNIGSSSVS (SEQ ID NO:51); an LCDR2 sequence KDNQRPS (SEQ ID NO:62); and an LCDR3 sequence ATWDNSLSIRV (SEQ ID NO:70).

In some embodiments, heavy chain variable region has a sequence having at least 90% identity to the sequence of EVQLVESGGALVKPGGSLRLSCAASGFTFSAAWMSWVRQAPGKGLEWVGRIKSVT DGETTDYAAPVKGRFTISRDDSKSTLYLQMNSLKTEDTAVYYCISSFCCRGNSCPSSD TSYCNGQYKSYYYMDVWGKGTTVTVSS (SEQ ID NO:86); and the light chain variable region has a sequence having at least 90% identity to the sequence of (SEQ ID NO: 132)
QSVLTQPPSASGTPGQRVTISCSGSKSNIGSSSVSWYQQLPGTAPKLLIYK

DNQRPSGVPDRFSGSKSGTSASLAISGLRSEDEADYYCATWDNSLSIRVFG

GGTKLTVL.

In some embodiments, the heavy chain variable region comprises a sequence EVQLVESGGALVKPGGSLRLSCAASGFTFSAAWMSWVRQAPGKGLEWVGRIKSVT DGETTDYAAPVKGRFTISRDDSKSTLYLQMNSLKTEDTAVYYCISSFCCRGNSCPSSD TSYCNGQYKSYYYMDVWGKGTTVTVSS (SEQ ID NO:86); and the light chain variable region comprises a sequence (SEQ ID NO: 132)
QSVLTQPPSASGTPGQRVTISCSGSKSNIGSSSVSWYQQLPGTAPKLLIYK

DNQRPSGVPDRFSGSKSGTSASLAISGLRSEDEADYYCATWDNSLSIRVFG

GGTKLTVL.

In some embodiments, the antibody comprises an HCDR1 sequence GFTFSKAWMT (SEQ ID NO:8); an HCDR2 sequence RIKSVTDGETTDYAAPVKG (SEQ ID NO:9); an HCDR3 sequence TSSFCCRGGSCPSHDTSFCGGQDKRYYYMDV (SEQ ID NO:34); an LCDR1 sequence SGSSSNIGSSSVS (SEQ ID NO:48); an LCDR2 sequence KNNQRPS (SEQ ID NO:59); and an LCDR3 sequence STWDDSLSVRV (SEQ ID NO:68).

In some embodiments, the heavy chain variable region has a sequence having at least 90% identity to the sequence of EVQLVESGGALVKPGGSLRLSCAASGFTFSKAWMTWVRQAPGKGLEWVGRIKSVT DGETTDYAAPVKGRFTISRDDSKSVLYLQMSSLKTEDTAVYFCTSSFCCRGGSCPSH DTSFCGGQDKRYYYMDVWGKGTTVTVSS (SEQ ID NO:95); and the light chain variable region has a sequence having at least 90% identity to the sequence of (SEQ ID NO: 141)
QSVLTQAPSASETPGQRVIISCSGSSSNIGSSSVSWYQQLPGTAPKLLIYK

NNQRPSGVPDRFSGSKSGTSASLAISGLRSEDEADYYCSTWDDSLSVRVFG

GGTKLTVL.

In some embodiments, the heavy chain variable region comprises a sequence EVQLVESGGALVKPGGSLRLSCAASGFTFSKAWMTWVRQAPGKGLEWVGRIKSVT DGETTDYAAPVKGRFTISRDDSKSVLYLQMS SLKTEDTAVYF CTS SFC CRGGS CP SH DTSFCGGQDKRYYYMDVWGKGTTVTVSS (SEQ ID NO:95); and the light chain variable region has a sequence comprises a sequence (SEQ ID NO: 141)
QSVLTQAPSASETPGQRVIISCSGSSSNIGSSSVSWYQQLPGTAPKLLIYK

NNQRPSGVPDRFSGSKSGTSASLAISGLRSEDEADYYCSTWDDSLSVRVFG

GGTKLTVL.

In some embodiments, the antibody comprises a heavy chain variable region comprising: an HCDR1 comprising a sequence GFTFSKAWMT (SEQ ID NO:8) or GFTFSKAWMS (SEQ ID NO:1), or a variant HCDR1 in which 1 or 2 amino acids are substituted relative to the sequence; an HCDR2 comprising a sequence RIKSVTDGETTDYAAPVKG (SEQ ID NO:9), or a variant HCDR2 in which 1 or 2 amino acids are substituted relative to the sequence; and an HCDR3 comprising a sequence TSSFCCRGGSCPSHDTSYCGGQYKSYYYMDV (SEQ ID NO:21), or a variant HCDR3, in which 1, 2, or 3 amino acids are substituted relative to the sequence; a light chain variable region comprising: an LCDR1 comprising a sequence SGSSDNIGSSSVS (SEQ ID NO: 1741), or a variant LCDR1 in which 1 or 2 amino acids are substituted relative to the sequence; an LCDR2 comprising a sequence KNNQRPS (SEQ ID NO:59), or variant LCDR2 in which 1 or 2 amino acids are substituted relative to the sequence; and an LCDR3 comprising a sequence STWDDSLSVRV (SEQ ID NO:68), or a variant LCDR3 in which 1 or 2 amino acids are substituted relative to the sequence.

In some embodiments, the antibody comprises: a heavy chain variable region comprising an FR1 that comprises a substitution at 1, 2, or 3 positions relative to the corresponding FR1 sequence of a VH region of any one of SEQ ID NOS:77-122 or 1333-1526 or 1725, an FR2 that comprises a substitution at 1, 2 or 3 positions relative to the corresponding FR2 sequence of a VH region of any one of SEQ ID NOS:77-122 or 1333-1526 or 1725, an FR3 that comprises a substitution at 1, 2, or 3 positions relative to the corresponding FR3 sequence of a VH region of any one of SEQ ID NOS:77-122 or 1333-1526 or 1725; and/or an FR4 that comprises a substitution at 1 or 2 positions relative to the corresponding FR4 sequence of a VH region of any one of SEQ ID NOS:77-122 or 1333-1526 or 1725; and a light chain variable region comprising an FR1 that comprises a substitution at 1, 2, or 3 positions relative to the corresponding FR1 sequence of a VL region any one of SEQ ID NOS:123-168 or 1527-1720 or 1726, an FR2 that comprises a substitution at 1, 2, or 3 positions relative to the corresponding FR2 sequence of a VL region any one of SEQ ID NOS:123-168 or 1527-1720 or 1726, an FR3 that comprises a substitution at 1, 2 or 3 positions relative to the corresponding FR3 sequence of a VL region any one of SEQ ID NOS:123-168 or 1527-1720 or 1726; and/or an FR4 that comprises a substitution at 1 or 2 positions relative to the corresponding FR4 sequence of a VL region any one of SEQ ID NOS:123-168 or 1527-1720 or 1726.

In some embodiments, the antibody comprises a $V_H$ having at least 95% identity to any one of SEQ ID NOS: 77-122 or 13333-1526 or 1725; and a corresponding $V_L$ having at least 95% identity to any one of SEQ ID NOS: 123-168 or 1527-1720 or 1726.

In some embodiments, the antibody comprises a heavy chain constant region sequence of SEQ ID NO:1721 and a light chain constant region sequence of SEQ ID NO:1722.

In a further aspect, provided herein is an antibody that binds to an extracellular RNA-protein complex, wherein the antibody comprises: a heavy chain variable region comprising: an HCDR1 comprising a sequence GFTFSKAWMS (SEQ ID NO:1), or a variant HCDR1 in which 1 amino acid is substituted relative to the sequence; an HCDR2 comprising a sequence RIKSVTDGETTDYAAPVKG (SEQ ID NO:9), or a variant HCDR2 in which 1 amino acid is substituted relative to the sequence; and an HCDR3 comprising a sequence TSSFCCRGGSCPSHDTSYCGGQYKSYYYMDV (SEQ ID NO:21), or a variant HCDR3 in which 1, 2, or 3 amino acids are substituted relative to the sequence; and a light chain variable region comprising: an LCDR1 comprising a sequence SGSSSNIGSSSVS (SEQ ID NO:48), or a variant LCDR1 in which 1 amino acid is substituted relative to the sequence;

an LCDR2 comprising a sequence KNNQRPS (SEQ ID NO:59), or variant LCDR2 in which 1 amino acid is substituted relative to the sequence; and an LCDR3 comprising a sequence STWDDSLSVRV (SEQ ID NO:68), or a variant LCDR3 in which 1 amino acid is substituted relative to the sequence.

In some embodiments, the antibody comprises an HCDR1 comprising a sequence GFTFSKAWMS (SEQ ID NO:1), an HCDR2 comprising a sequence RIKSVTDGETTDYAAPVKG (SEQ ID NO:9), an HCDR3 comprising a sequence TSSFCCRGGSCPSHDTSYCGGQYKSYYYMDV (SEQ ID NO:21), an LCDR1 comprising a sequence SGSSSNIGSSSVS (SEQ ID NO:48), an LCDR2 comprising a sequence KNNQRPS (SEQ ID NO:59), and an LCDR3 comprising a sequence STWDDSLSVRV (SEQ ID NO:68). In some embodiments, the $V_H$ comprises an amino acid sequence having at least 95% identity to EVQLVESGGALVKPGGSLRLSCAASGFTFSKAWMSWVRQAPGKGLEWVGRIKSVT DGETTDYAAPVKGRFTISRDDSKSTLYLQMNSLKTEDTAVYYCTSSFCCRGGSCPSH DTSYCGGQYKSYYYMDVWGKGTTVTVSS (SEQ ID NO:94); and the $V_L$ comprises an amino sequence having at 95% identity to QSVLTQPPSASGTPGQRVTISCSGSSSNIGSSSVSWYQQLPGTAPKLLIYKNNQRPSGV PDRFSGSKSGTSASLAISGLRSEDEADYYCSTWDDSLSVRVFGGGTKLTVL (SEQ ID NO:140). In some embodiments, the $V_H$ comprises a sequence EVQLVESGGALVKPGGSLRLSCAASGFTFSKAWMSWVRQAPGKGLEWVGRIKSVT DGETTDYAAPVKGRFTISRDDSKSTLYLQMNSLKTEDTAVYYCTSSFCCRGGSCPSH DTSYCGGQYKSYYYMDVWGKGTTVTVSS (SEQ ID NO:94); and the $V_L$ comprises a sequence QSVLTQPPSASGTPGQRVTISCSGSSSNIGSSSVSWYQQLPGTAPKLLIYKNNQRPSGV PDRFSGSKSGTSASLAISGLRSEDEADYYCSTWDDSLSVRVFGGGTKLTVL (SEQ ID NO:140). In some embodiments, the antibody comprises a heavy chain constant region sequence of SEQ ID NO:1721 and a light chain constant region sequence of SEQ ID NO:1722. In some embodiments, the heavy chain comprises a sequence of SEQ ID NO:1723 and the light chain comprises a sequence of SEQ ID NO:1724.

In a further aspect, provided herein is a method of inducing an immune response, the method comprising administering any one of the antibodies described in the preceding paragraphs in this section to a subject. In some embodiments, the immune response comprises an ADCP response. In some embodiments, the antibody is administered intravenously.

In a further aspect, provided herein is a method of treating a cancer patient having a tumor that comprises an extracellular RNA-protein complex, the method comprising administering any one of the antibodies described in the preceding paragraphs to the patient. In some embodiments, the antibody is an antibody as described in any of the ninth through thirty-second paragraphs of the Brief Summary section. In some embodiments, the cancer is lung cancer, breast cancer, colorectal cancer, esophageal cancer, stomach cancer, kidney cancer, ovarian cancer, melanoma, uterine cancer, liver cancer, bladder cancer, or testicular cancer. In some embodiments, the cancer is non-small cell lung cancer, triple negative breast cancer, colorectal cancer, ovarian cancer or melanoma. In some embodiments, the antibody is administered intravenously. In some embodiments, the method further comprises administering chemotherapy and/or radiation therapy. In some embodiments, the method further comprises administering an agent that targets an immunological checkpoint antigen. In some embodiments, the agent is a monoclonal antibody. In some embodiments, the monoclonal antibody blocks PD-1 ligand binding to PD-1. In some embodiments, the monoclonal antibody is an anti-PD-1 antibody.

In a further aspect, provided herein is a method of identifying a patient that has a tumor comprising an extracellular RNA-protein complex, the method comprising contacting a tumor sample from the patient with an antibody as described in the preceding paragraphs.

In another aspect, provided herein is an expression vector comprising a polynucleotide encoding the $V_H$ region of an antibody as set forth in the preceding paragraphs. Additionally provided herein is an expression vector comprising a polynucleotide encoding the $V_L$ region of an antibody of as set forth in the preceding paragraphs. In some embodiments, an expression vector comprises a polynucleotide encoding the $V_H$ region and the $V_L$ region of the antibody. In some embodiments, an express vector provided herein comprises a polynucleotide encoding a $V_H$ or $V_L$ CDR3 of an antibody set forth in any one of the preceding paragraphs. Also provided herein are host cells that comprise an expression vector as described in this paragraph. In some embodiments, the host cell is a CHO cell, such as a CHO K-1 cell.

Additionally provided herein is a method of producing an antibody, the method comprising culturing a host cell as described in the preceding paragraph under conditions in which the polynucleotide encoding the heavy chain and the polynucleotide encoding the light chain are expressed.

In a further aspect, provided herein is a method of identifying an antibody having anti-tumor activity, the method comprising mutagenizing a polynucleotide encoding a $V_H$ or a $V_L$ CDR3 of any one of the antibodies as described in the preceding paragraphs, expressing an antibody comprising the mutagenized $V_H$ or $V_L$ CDR3; and selecting an antibody that inhibits tumor growth or decreases tumor size, tumor invasion, and/or metastasis in vivo.

In a further aspect, provided herein is a use of any one of the antibodies described in the preceding paragraphs in a method of inducing an immune response in vivo. Further provided herein is a use of any one of the antibodies described in the preceding paragraphs for a method of treating cancer. In some embodiments, cancer is treated in a subject having a tumor that comprises an extracellular RNA-protein complex. In some embodiments, the cancer is lung cancer, breast cancer, colorectal cancer, esophageal cancer, stomach cancer, kidney cancer, ovarian cancer, melanoma, uterine cancer, liver cancer, bladder cancer, or testicular cancer. In some embodiments, the cancer is non-small cell lung cancer, triple negative breast cancer, colorectal cancer, ovarian cancer or melanoma. In some embodiments, the antibody is administered intravenously. In some embodiments, the method further comprises administering chemotherapy and/or radiation therapy. In some embodiments, the method further comprising an agent that targets an immunological checkpoint antigen. In some embodiments, the agent is a monoclonal antibody. In some embodiments, the monoclonal antibody blocks PD-1 ligand binding to PD-1. In some embodiments, the monoclonal antibody is an anti-PD-1 antibody.

In a further aspect, provided herein is a polypeptide comprising a $V_H$ sequence EVQLVESGGALVKPGGSLRLSCAASGFTFSKAWMSWVRQAPGKGLEWVGRIKSVT DGETTDYAAPVKGRFTISRDDSKSTLYLQMNSLKTEDTAVYYCTSSFCCRGGSCPSH DTSYCGGQYKSYYYMDVWGKGTTVTVSS (SEQ ID NO:94); and a $V_L$ sequence QSVLTQPP- SASGTPGQRVTISCSGSSSNIGSSSVSWYQQLPGTA-PKLLIYKNNQRPSGV PDRFSGSKSGTSASLAIS-GLRSEDEADYYCSTWDDSLSVRVFGGGTKLTVL (SEQ ID NO:140). Additionally provided herein is a polypeptide comprising a heavy chain sequence of SEQ ID NO:1723 and a light chain region sequence of SEQ ID NO:1724.

In further aspect, provided herein is an anti-tumor antibody comprising a heavy chain variable ($V_H$) region and a light chain variable (L) region, wherein: (a) the $V_H$ region comprises a CDR1 sequence comprising GFTFSKAWMS (SEQ ID NO:1), or a variant thereof having 1, 2, or 3 substitutions, a CDR2 sequence comprising RIKSVTDGETTDYAAPVKG (SEQ ID NO:9), RIKSVTEGETTDYAAPVKG (SEQ ID NO:17), or RIKSTSDGGITDYAAPVKG (SEQ ID NO:16), or a variant of the CDR2 sequence having 1, 2, 3, 4, or 5 amino acid substitutions; and a CDR3 sequence comprising T(S/T)SFCCRGG(R/S)CPS(H/R)DTS(Y/F)CGG(Q/S)(Y/D)(K/N/S)(R/S)YYYMDV (SEQ ID NO: 1747), as numbered with reference to any one of SEQ ID NOS:77-122; and (b) the $V_L$ region comprises a CDR1 sequence comprising SGSSSNIGSSSVS (SEQ ID NO:48), or a variant thereof having 1, 2, 3, or 4 amino acid substitutions, a CDR2 comprising KNNQRPS (SEQ ID NO:59), or a variant thereof having 1 or 2 amino acid substitutions, and a CDR3 sequence comprising STWD(D/E)DSLSVRV (SEQ ID NO: 1748), as numbered with reference to any one of SEQ ID NOS:77-122. In some embodiments, the $V_H$ region comprises a CDR1 variant sequence GFTFSKAWM(S/T) (SEQ ID NO: 1749) and/or a CDR2 sequence RIKS(V/T)(T/S)(D/E)G(E/G)(I/T)TDYAAPVKG (SEQ ID NO: 1750). In some embodiments, the $V_H$ CDR3 sequence comprises:

```
                                        (SEQ ID NO: 1751)
T(S/T)SFCCRGG(R/S)CPS(H/R)DTS(Y/F)CGG(Q/S)YKSYYYMD
V,
                                        (SEQ ID NO: 1752)
T(S/T)SFCCRGG(R/S)CPS(H/R)DTS(Y/F)CGG(Q/S)DSRYYYMD
V,
                                        (SEQ ID NO: 1753)
T(S/T)SFCCRGG(R/S)CPS(H/R)DTS(Y/F)CGG(Q/S)YNRYYYMD
V,
                                        (SEQ ID NO: 1754)
T(S/T)SFCCRGG(R/S)CPS(H/R)DTS(Y/F)CGG(Q/S)YNSYYYMD
V,
or
                                        (SEQ ID NO: 1755)
T(S/T)SFCCRGG(R/S)CPS(H/R)DTS(Y/F)CGG(Q/S)DKRYYYMD
V.
```

In some embodiments, the $V_H$ region comprises a CDR1 variant sequence GFTFSKAWMT (SEQ ID NO:8), a CDR2 sequence RIKSVT(D/E)GETTDYAAPVKG (SEQ ID NO: 1756), and a CDR3 sequence T(S/T)SFCCRGGSCPSHDTS(Y/F)CGG(Q/S)(Y/D)(K/N/S)(R/S)YYYMDV (SEQ ID NO: 1757), e.g., T(S/T)SFCCRGGSCPSHDTS(Y/F)CGG(Q/S)YKSYYYMDV (SEQ ID NO: 1758), T(S/T)SFCCRGGSCPSHDTS(Y/F)CGG(Q/S)DSRYYYMDV (SEQ ID NO: 1759), T(S/T)SFCCRGGSCPSHDTS(Y/F)CGG(Q/S)YNRYYYMDV (SEQ ID NO: 1760), or T(S/T)SFCCRGGSCPSHDTS(Y/F)CGG(Q/S)DKRYYYMDV (SEQ ID NO: 1761). In some embodiments, the $V_H$ comprises a CDR3 sequence TSSFCCRGGSCPSHDTSFCGGQYKSYYYMDV (SEQ ID NO:37), TTSFCCRGGSCPSHDTSFCGGQYKSYYYMDV (SEQ ID NO:39), TSSFCCRGGSCPSHDTSFCGGQDSRYYYMDV (SEQ ID NO:40), TSSFCCRGGSCPSHDTSYCGGQYKSYYYMDV (SEQ ID NO:21), TSSFCCRGGSCPSHDTSFCGGSYKSYYYMDV (SEQ ID NO:41), TSSFCCRGGSCPSHDTSYCGGQDSRYYYMDV (SEQ ID NO:42), TSSFCCRGGSCPSHDTSFCGGQYNRYYYMDV (SEQ ID NO:36), TSSFCCRGGRCPSRDTSFCGGQYNSYYYMDV (SEQ ID NO:1740), TSSFCCRGGSCPSHDTSFCGGQDKRYYYMDV (SEQ ID NO:34), or TTSFCCRGGSCPSHDTSFCGGQDKRYYYMDV (SEQ ID NO:35). In some embodiments, the anti-tumor antibody comprises a $V_H$ CDR1, CDR2, and/or CDR3 as set forth in Table 1B. In some embodiments, the anti-tumor antibody comprises a $V_L$ region comprising a CDR1 sequence SGSSSNIGSSSVS (SEQ ID NO:48), or a variant thereof having 1, 2, 3, or 4 amino acid substitutions; a CDR2 sequence KNNQRPS (SEQ ID NO:59), or a variant thereof having 1, 2, or 3 substitutions, and a CDR3 sequence STWD(D/E)SLSVRV (SEQ ID NO: 1762). In some embodiments, the CDR1 sequence is SGSSSNIGSSSVS (SEQ ID NO:48) and/or the CDR2 sequence is KNNQRPS (SEQ ID NO:59).

Further provided herein is an anti-tumor antibody comprising a $V_H$ region and a $V_L$ region, wherein: (a) the $V_H$ region comprises a CDR1 sequence having at least 80% identity to a CDR1 sequence set forth in Table 1B, at least 80% identity to a CDR2 sequence set forth in Table 1B; and at least 80% identity to a CDR3 sequence set forth in Table 1B; and (b) the $V_L$ region comprises: (i) a CDR1 sequence having at least 80% identity of a CDR1 sequence set forth in Table 1B a CDR2 sequence having at least 80% identity to a CDR2 sequence set forth in Table 1B and a CDR3 sequence having at least 80% identity to a CDR3 sequence set forth in 1B. In some embodiments, the antibody comprises a $V_H$ comprising an FR1 having at least 90% identity to the amino acid sequence from positions 1 to 25 of any one of SEQ ID NOS:77-122, an FR2 having at least 90% identity to the amino acid sequence from positions 36 to 49 of any one of SEQ ID NOS:77-122, an FR3 having at least 90% identity to the amino acid sequence from positions 69 to 98 of any one of SEQ ID NOS: of any one of SEQ ID NOS:77-122; and/or an FR4 having at least 90% identity to the amino acid sequence from positions 130-140 as determined with reference to any one of SEQ ID NOS: of any one of SEQ ID NOS:77-122. In some embodiments, the anti-tumor antibody comprises a $V_L$ comprising an FR1 having at least 90% identity to the amino acid sequence from positions 1 to 22 of one of SEQ ID NOS:123-168, an FR2 having at least 90% identity to the amino acid sequence from positions 36 to 50 of any one of SEQ ID NOS: 123-168, an FR3 having at least 90% identity to the amino acid sequence from positions 58 to 89 of any one of SEQ ID NOS: 123-168; and/or an FR4 having at least 90% identity to the amino acid sequence from positions 101 to 110 as determined with reference to any one of SEQ ID NOS: 123-168. In some embodiments, the antibody comprises a $V_H$ region having at least 70% identity to any one of SEQ ID NOS:77-122; and/or a $V_L$ having at least 70% identity to any one of SEQ ID NOS:123-168. In some embodiments, the $V_H$ region has at least 80% identity to any one of SEQ ID NOS:77-122; and/or the $V_L$ region has at least 80% identity to any one of SEQ ID NOS:123-168. In some embodiments, the $V_H$ region has at least 90% identity to any one of SEQ ID NOS:77-122;

and/or the $V_L$ region has at least 90% identity to any one of SEQ ID NOS:123-168. In further embodiments, the $V_H$ region has at least 95% identity to any one of SEQ ID NOS:77-122; and/or the $V_L$ region has at least 95% identity to any one of SEQ ID NOS:123-168.

In some embodiments, an anti-tumor antibody or antibody that can be employed to evaluate a tumor sample that has an extracellular RNA-protein complex comprises:

a $V_H$ region comprising amino acid sequence SEQ ID NO:101 and a $V_L$ region comprising amino acid sequence SEQ ID NO:147;

a $V_H$ region comprising amino acid sequence SEQ ID NO:102 and a $V_L$ region comprising amino acid sequence SEQ ID NO:148;

a $V_H$ region comprising amino acid sequence SEQ ID NO:203 and a $V_L$ region comprising amino acid sequence SEQ ID NO:149;

a $V_H$ region comprising amino acid sequence SEQ ID NO:104 and a $V_L$ region comprising amino acid sequence SEQ ID NO:150;

a $V_H$ region comprising amino acid sequence SEQ ID NO:105 and a $V_L$ region comprising amino acid sequence SEQ ID NO:151;

a $V_H$ region comprising amino acid sequence SEQ ID NO:106 and a $V_L$ region comprising amino acid sequence SEQ ID NO:152;

a $V_H$ region comprising amino acid sequence SEQ ID NO:107 and a $V_L$ region comprising amino acid sequence SEQ ID NO:153;

a $V_H$ region comprising amino acid sequence SEQ ID NO:94 and a $V_L$ region comprising amino acid sequence SEQ ID NO:140;

a $V_H$ region comprising amino acid sequence SEQ ID NO:1335 and a $V_L$ region comprising amino acid sequence SEQ ID NO:1529;

a $V_H$ region comprising amino acid sequence SEQ ID NO:108 and a $V_L$ region comprising amino acid sequence SEQ ID NO:154;

a $V_H$ region comprising amino acid sequence SEQ ID NO:97 and a $V_L$ region comprising amino acid sequence SEQ ID NO:143;

a $V_H$ region comprising amino acid sequence SEQ ID NO:98 and a $V_L$ region comprising amino acid sequence SEQ ID NO:144;

a $V_H$ region comprising amino acid sequence SEQ ID NO:109 and a $V_L$ region comprising amino acid sequence SEQ ID NO:155;

a $V_H$ region comprising amino acid sequence SEQ ID NO:110 and a $V_L$ region comprising amino acid sequence SEQ ID NO:156;

a $V_H$ region comprising amino acid sequence SEQ ID NO:1136 and a $V_L$ region comprising amino acid sequence SEQ ID NO:1530;

a $V_H$ region comprising amino acid sequence SEQ ID NO:99 and a $V_L$ region comprising amino acid sequence SEQ ID NO:145;

a $V_H$ region comprising amino acid sequence SEQ ID NO:95 and a $V_L$ region comprising amino acid sequence SEQ ID NO:141;

a $V_H$ region comprising amino acid sequence SEQ ID NO:100 and a $V_L$ region comprising amino acid sequence SEQ ID NO:146;

a $V_H$ region comprising amino acid sequence SEQ ID NO:96 and a $V_L$ region comprising amino acid sequence SEQ ID NO:142;

a $V_H$ region comprising amino acid sequence SEQ ID NO:1333 and a $V_L$ region comprising amino acid sequence SEQ ID NO:1527; or a $V_H$ region comprising amino acid sequence SEQ ID NO:1334 and a $V_L$ region comprising amino acid sequence SEQ ID NO:1528.

In some embodiments, an antibody as described herein, e.g., an anti-tumor antibody having a $V_H$ and corresponding $V_L$ set forth in Table 1A, comprises an IgG1 heavy chain constant region having at least 90% identity to SEQ ID NO:1721 and a lambda light chain constant region having at least 90% identity to SEQ ID NO:1722. In some embodiments, the IgG1 heavy chain constant region comprises the sequence of SEQ ID NO:1721 and the lambda light chain constant region comprises the sequence of SEQ ID NO:1722.

In a further aspect, provided here is an expression vector comprising a polynucleotide encoding the $V_H$ region and/or the $V_L$ region of an antibody as described herein, e.g., in the preceding two paragraphs. Additionally, provided herein is an expression vector comprising a polynucleotide encoding a $V_H$ or $V_L$ CDR3 of an anti-tumor antibody as described herein, e.g., in the preceding two paragraphs. The disclosure further provides a host cell comprising an expression vector of the present disclosure, e.g., as described herein; or a host cell that comprises a polynucleotide as that encodes a $V_H$ region and/or a $V_L$ region of the anti-tumor antibody as described herein, e.g., in the preceding two paragraphs.

In an additional aspect, provided herein is a method of identifying an antibody having anti-tumor activity, or tumor-binding activity, the method comprising mutagenizing a polynucleotide encoding a $V_H$ or a $V_L$ CDR3 as set forth in Table 1B or 2B, expressing an antibody comprising the mutagenized $V_H$ or $V_L$ CDR3; and selecting an antibody that inhibits tumor growth, decreases tumor size, decreases tumor invasion and/or metastasis in vivo.

In a further aspect, provided herein is a method of treating a cancer, the method comprising administering an antibody of the present disclosure to a patient that has cancer, such as lung cancer, breast cancer, colorectal cancer, esophageal cancer, stomach cancer, kidney cancer, ovarian cancer, melanoma, uterine cancer, liver cancer, bladder cancer, or testicular cancer. In some embodiments, the patient is also administered a chemotherapeutic agent and/or radiation therapy, e.g., prior to receiving the anti-tumor antibody. In some embodiments, the patient is additionally administered a therapeutic agent that targets an immunological checkpoint antigen, e.g., the therapeutic agent is a checkpoint inhibitor such as a monoclonal antibody that targets the PD-1/PD-L1 immunological checkpoint, such as an anti-PD-1 antibody or an anti-PD-L1 antibody.

In a further aspect, provided herein is an anti-tumor antibody comprising a heavy chain and a light chain, wherein the heavy chain comprises a heavy chain variable region ($V_H$) that comprises a CDR1 comprising GFTFSKAWMS (SEQ ID NO:1), a CDR2 comprising RIKSVTDGETTDYAAPVKG (SEQ ID NO:9), and a CDR3 comprising TSSFCCRGGSCP-SHDTSYCGGQYKSYYYMDV (SEQ ID NO:21); and the light chain comprises a light chain variable region ($V_L$) that comprises a CDR1 comprising SGSSSNIGSSSVS (SEQ ID NO:48), a CDR2 comprising KNNQRPS (SEQ ID NO:59), and a CDR3 comprising STWDDSLSVRV (SEQ ID NO:68); and further wherein the antibody comprises an IgG1 heavy chain constant region having at least 90% identity to SEQ ID NO:1721 and a lambda light chain constant region having at least 90% identity to SEQ ID NO:1722. In some embodiments, the IgG1 heavy chain constant region comprises the sequence of SEQ ID NO:1721 and the lambda light chain constant region comprises the sequence of SEQ ID NO:1722. In some embodiments, the anti-tumor antibody comprises a $V_H$ region having a sequence of SEQ ID NO:94 and a $V_L$ region having a sequence of SEQ ID NO:140. In some embodiments an anti-tumor antibody as described herein comprises a heavy chain amino acid sequence of SEQ ID NO:1723 and a light chain amino acid sequence of SEQ ID NO:1724.

In another aspect, provided herein is a pharmaceutical composition comprising an anti-tumor antibody as described herein, e.g., in the previous paragraph, and a physiologically acceptable carrier. In some embodiments, the pharmaceutical composition comprises 20 mM histidine buffer, 8% (w/v) sucrose, 0.02% (w/v) polysorbate 80 at pH 5.5. In some embodiments, the antibody is stored at a concentration of 20 mg/ml.

In another aspect, provided herein is a method of treating cancer that comprises administering a pharmaceutical composition of the previous paragraph above to a patient that has cancer. In some embodiments, the patient has lung cancer, breast cancer, colorectal cancer, esophageal cancer, stomach cancer, kidney cancer, ovarian cancer, melanoma, uterine cancer, liver cancer, bladder cancer, or testicular cancer. In particular embodiments, the patient has non-small cell lung cancer, colorectal cancer, breast cancer, ovarian cancer, or melanoma. In certain embodiments, the melanoma is acral melanoma. In some embodiments, the pharmaceutical composition is administered intravenously. In particular embodiments, the pharmaceutical composition is administered intravenously at a dose in the range of 0.1 mg/kg to 100 mg/kg (e.g., 0.3 mg/kg to 30 mg/kg). In some embodiments, the pharmaceutical composition is administered once every three weeks. In some embodiments, the method can further comprise administering chemotherapy and/or radiation therapy. In some embodiments, the method can further comprise administering an agent that targets an immunological checkpoint antigen. In certain embodiments, the agent that targets an immunological checkpoint antigen can be a monoclonal antibody, e.g., a monoclonal antibody that blocks PD-1 ligand binding to PD-1. In certain embodiments, the monoclonal antibody is an anti-PD-1 antibody.

In another aspect, provided herein is a polynucleotide comprising a nucleic acid sequence encoding a heavy chain of an anti-tumor antibody described herein. In another aspect, provided herein is an expression vector comprising the polynucleotide. In another aspect, the disclosure also features a host cell that comprises the polynucleotide. In another aspect, the disclosure also features a host cell that comprises the expression vector.

In another aspect, the disclosure features a polynucleotide comprising a nucleic acid sequence encoding a light chain of an anti-tumor antibody described herein. In another aspect, the disclosure also features an expression vector comprising the polynucleotide. In another aspect, the disclosure also features a host cell that comprises the polynucleotide. In another aspect, the disclosure also features a host cell that comprises the expression vector.

In another aspect, the disclosure also features an expression vector comprising the polynucleotide that comprises a nucleic acid sequence encoding a heavy chain of an anti-tumor antibody described herein and the polynucleotide that comprises a nucleic acid sequence encoding a light chain of an anti-tumor antibody described herein. In anther aspect, the disclosure also features a host cell that comprises the expression vector.

In another aspect, the disclosure also features a host cell that comprises two polynucleotides, one polynucleotide comprising a polynucleotide comprising a nucleic acid sequence encoding a heavy chain of an anti-tumor antibody described herein, and another polynucleotide comprising a nucleic acid sequence encoding a light chain of an anti-tumor antibody described herein.

In another aspect, the disclosure also features a host cell that comprises two expression vectors, one expression vector comprising a polynucleotide comprising a nucleic acid sequence encoding a heavy chain of an anti-tumor antibody described herein, and another expression vector comprising a polynucleotide comprising a nucleic acid sequence encoding a light chain of an anti-tumor antibody described herein.

In some embodiments, the host cell described herein is a CHO cell, e.g., a CHO-K1 cell.

In another aspect, the disclosure features a method of producing an antibody described here. The method comprises culturing a host cell described herein under conditions in which the polynucleotide encoding the heavy chain and the polynucleotide encoding the light chain are expressed.

In another aspect, the disclosure features a method of producing an antibody described herein. The method comprises culturing a host cell that has a polynucleotide comprising a nucleic acid sequence encoding a heavy chain of an anti-tumor antibody described herein and a host cell that has a polynucleotide comprising nucleic acid sequence encoding a light chain of an anti-tumor antibody described herein together under conditions in which the polynucleotide encoding the heavy chain and the polynucleotide encoding the light chain are expressed from their respective host cells.

In another aspect, the disclosure features a method of producing an antibody described herein. The method comprises culturing a host cell that has an expression vector that comprises a polynucleotide comprising a nucleic acid sequence encoding a heavy chain of an anti-tumor antibody described herein and another host cell that has an expression vector that comprises a polynucleotide comprising a nucleic acid sequence encoding a light chain of an anti-tumor antibody described herein together under conditions in which the polynucleotide encoding the heavy chain and the polynucleotide encoding the light chain are expressed from their respective host cells.

In any of the methods of producing an antibody described herein, in some embodiments, the host cell is a CHO cell, e.g., a CHO-K1 cell. In some embodiments, the method further comprises purifying the antibody.

BRIEF DESCRIPTION OF THE DRAWINGS

FIG. 8 summarizes the design of a study to test individual variants as monotherapies and in combination with an anti-PD-1 antibody in the EMT-6 mouse tumor model.

FIG. 25 provides a schematic of an ex vivo binding assay to determine correlation with in vivo anti-tumor activity.

FIG. 33B-D are higher magnification images of certain areas within the image of FIG. 33A, taken in each case from one plane of a three-dimensional reconstruction. The confocal imaging three-dimensional reconstruction results show that the AIP-160470 reactivity is clearly extracellular in nature, supporting the conclusions of the flow cytometry data shown in FIGS. 35A and 35B.

FIG. 34B-D are higher magnification images of certain areas within the image of FIG. 34A, taken in each case from one plane of a three-dimensional reconstruction. The confocal imaging three-dimensional reconstruction results show that the mass of CD9-positive vesicles is external to nearby cells.

FIGS. 37A, 37AA, 37B and 37BB. Kabat, Chothia, and IMGT numbering of AIP-160470. FIGS. 37A and 37AA disclose SEQ ID NO: 94. FIGS. 37B and 37BB disclose SEQ ID NO: 123.

FIGS. 38A and 38B. FIGS. 38A and 38B provide data showing that RNA is preferentially immunoprecipitated by AIP-192482. Immunoprecipitation from A549 lysates was performed and bound RNA was extracted with Trizol then purified using a Zymo Quick-RNA Miniprep kit. Following purification, RNA was quantified via Qubit and analyzed on an Agilent Bioanalyzer 2100 with the RNA 6000 pico assay. RNA was then processed for sequencing using the NEBNext Ultra II RNA Library Prep Kit for Illumina and sequenced on an Illumina MiSeq with a V3 600 cycle (2×300 PE) sequencing kit. Reads were filtered for quality using After QC, then aligned to human genome hg19 using TopHat and mapped reads were quantified using featureCounts.

FIG. 39A-F show variant activity in an in vitro FcR engagement assay.

FIG. 40 lists variants selected for Round 1 in vivo study.

FIG. 41 lists variants selected for Round 2 in vivo study. FIG. 41 discloses SEQ ID NOS 20 and 22-26, respectively, in order of appearance.

FIG. 42 shows the study design for in vivo activity.

FIG. 49 provides a summary of the in vivo activity of a subset of variant antibodies having anti-tumor effects is provided in FIG. 49. FIG. 49 discloses SEQ ID NO: 23.

FIG. 39B). Sections were stained using 1.25 μg/mL Alexa Fluor 647-conjugated chimeric antibody AIP-160470-mIgG2a. Adjacent sections were incubated with a rabbit polyclonal PABPC-1 antibody detected with an anti-rabbit secondary antibody conjugated to Alexa Fluor 647 or H&E stain. FFPE=formalin-fixed paraffin-embedded; H&E=hematoxylin and eosin; μg=microgram; mIgG2a=mouse immunoglobulin G, subclass 2a; mL=milliliter; PABPC-1=cytoplasmic polyadenylate-binding protein 1; RabIgG=rabbit immunoglobulin G; TMA=tissue microarray.

FIGS. 55A and 55B show dose-dependent tumor growth inhibition by ATRC-101 and the chimeric antibody AIP-160470-mIgG2a in the EMT6-BALB/c syngeneic mouse tumor model. BALB/c mice were inoculated with $1\times10^6$ EMT6 tumor cells and dosed IP twice weekly with indicated doses of chimeric antibody MFC-042 (AIP-160470-mIgG2a; FIG. 41A) or the ATRC-101 (FIG. 41 B), when group MTV reached 112 to 113 $mm^3$ and 108 $mm^3$, respectively. Shown are the mean and standard error of the mean for each treatment group (15 animals/group). IP=intraperitoneally; kg=kilogram; mg=milligram; MTV=mean tumor volume.

FIG. 44A shows the tumor volumes of individual mice in AIP-192482-mIgG2a treatment groups and control groups through Day 35. FIG. 44B shows the tumor volumes of individual mice in AIP-160470-mIgG2a treatment groups and control groups through Day 35. CR=complete tumor regression; DPBS=Dulbecco's phosphate-buffered saline; IP=intraperitoneally; kg=kilogram; mg=milligram; mIgG2a=mouse immunoglobulin G, subclass 2a; mm=millimeter; PD-1=programmed death receptor 1.

FIG. 45A shows the tumor volumes of individual mice in each treatment group through Day 35. FIG. 45B shows the tumor volumes for treatment groups dosed with AIP-192482-mIgG2a through Day 97. The number of CR through Day 97 are indicated. DPBS=Dulbecco's phosphate-buffered saline; IP=intraperitoneally; kg=kilogram; mg=milligram; mIgG2a=mouse immunoglobulin G, subclass 2a; mm=millimeter

CR=complete tumor regression; DPBS=Dulbecco's phosphate-buffered saline; IP=intraperitoneally; kg=kilogram; mg=milligram; mIgG2a=mouse immunoglobulin G, subclass 2a; mm=millimeter; PD-1=programmed death receptor 1.

Figure 61:
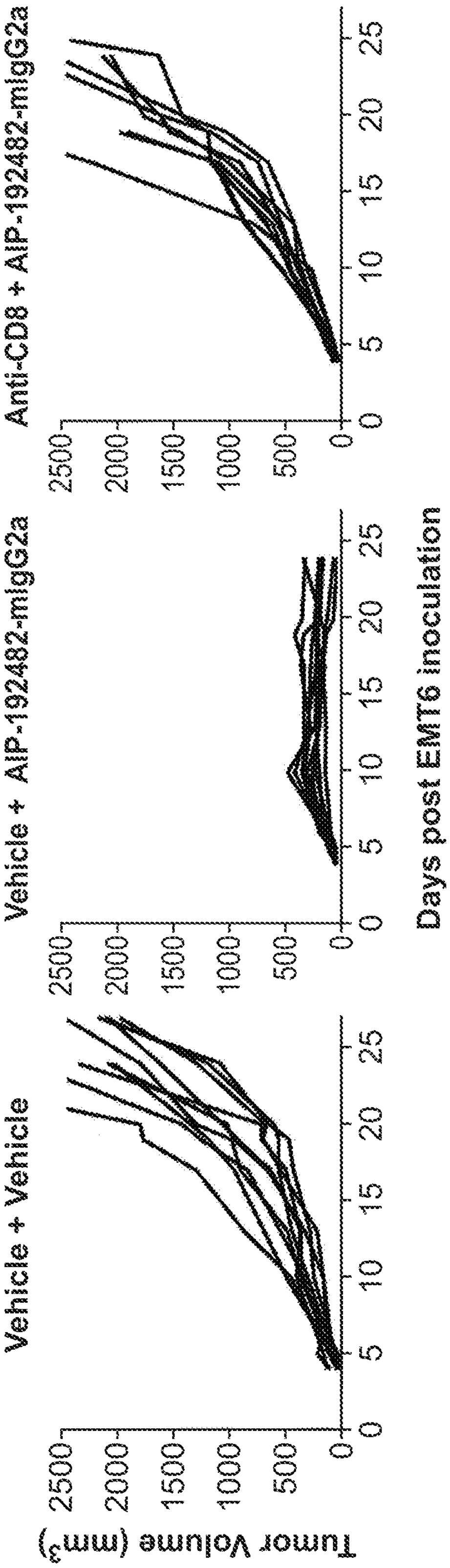
Figure 62B:
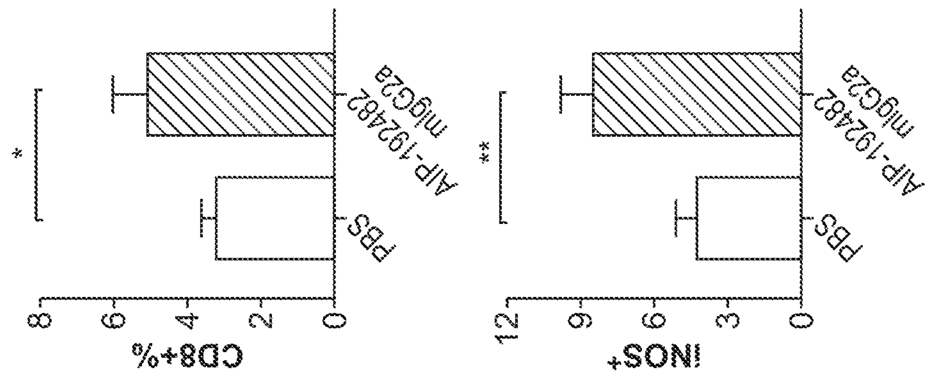
Figure 62A:
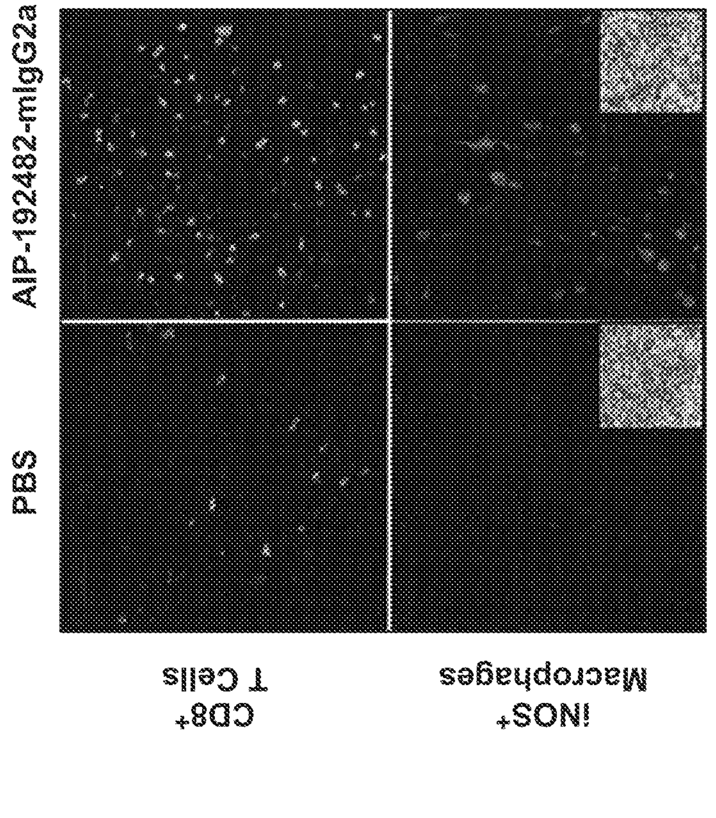

FIG. 61 shows assessment of T Cell Requirement for Anti-tumor Efficacy in the EMT6-BALBc Syngeneic Mouse Tumor Model, Study TMD04. In study TMD04, BALB/c mice were inoculated with $1\times10^6$ EMT6 cells and dosed IP with DPBS or anti-mouse CD8a antibody, clone 2.43 (BioXCell), three times weekly starting on Day 6. Chimeric parental antibody AIP-192482-mIgG2a or vehicle (DPBS) was dosed IP at 10 mg/kg twice weekly starting on Day 7 (10 animals per group). Shown are the individual tumor volumes through Day 27. DPBS=phosphate-buffered saline; IP=intraperitoneal(ly); mIgG2a=mouse immunoglobulin G, subclass 2a FIGS. 62A and 62B show that Assessment of CD8+ T Cells and M1-Polarization of Macrophages in EMT6 Tumors In Vivo following Treatment with Chimeric Parental Antibody AIP-192482-mIgG2a. BALB/c mice with established EMT6 tumors were dosed with vehicle (DPBS) or 20 mg/kg of chimeric parental antibody AIP-192482-mIgG2a on Days 7, 10, 14 as part of anti-tumor study EFF-004. EMT6 tumors were harvested from representative mice on study Day 15. Samples were sectioned and stained with anti-CD8 or anti-iNOS antibodies by tyramide signaling amplification immunofluorescence methodology. FIG. 48A shows representative tumor sections stained from animals treated with DPBS or AIP-192482-mIgG2a for the presence of CD8+ T cells or iNOS+ macrophages (green). The inset shows H&E staining from an adjacent section. White lines on black background indicates 50 μm. FIG. 48B shows the proportion of CD8+ (5 animals) and iNOS+ cells (10 animals) following DPBS or AIP-192482-mIgG2a administration. Significance was assessed by unpaired t-test, with *=$p<0.05$; =$p<0.01$. DPBS=Dulbecco's phosphate-buffered saline; H&E=hematoxylin and eosin; iNOS=inducible nitric oxide synthase; mIgG2a=mouse immunoglobulin G, subclass 2a; PBS=Dulbecco's phosphate-buffered saline FIG. 63** shows the serum concentrations in Cynomolgus Monkey following Single Dose Intravenous Administration of ATRC-101 (Study ATRC-101.PK.18.01). Male and female cynomolgus monkeys were given one intravenous bolus injections of 1 mg/kg, 10 mg/kg, or 30 mg/kg ATRC-101. Blood samples were collected 5 minutes and 1, 4, 8, 12, 24, 48, 96, 168, 240, 336, 504, and 672 hours post dose. Shown are the ATRC-101 blood serum concentrations measured by ELISA. ELISA=enzyme-linked immunosorbent assay.

Figure 64:
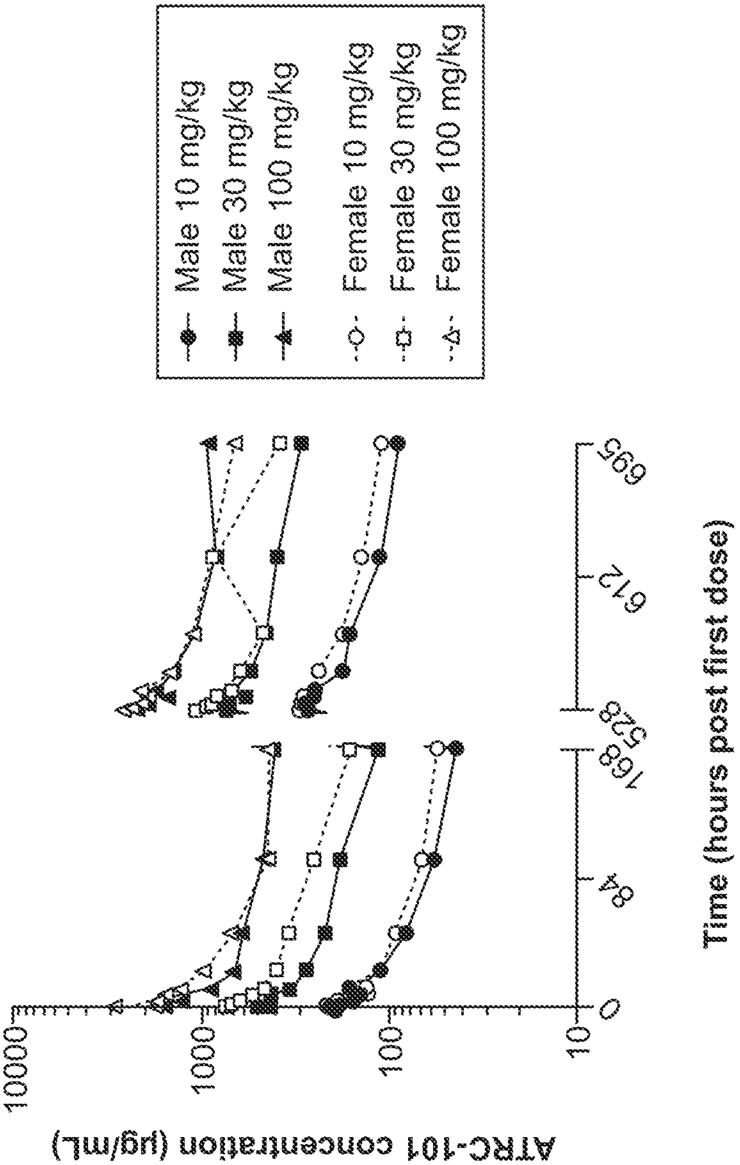

FIG. 64 shows Serum Concentrations in Cynomolgus Monkey Following Repeat Dose Administration of ATRC-101 (Study ATRC-101.TX.18.01). Male and female cynomolgus monkeys were given once weekly administration via IV infusion at 10 mg/kg, 30 mg/kg, or 100 mg/kg ATRC-101 for a total of 4 doses. Blood samples were collected 15 minutes and 1, 4, 8, 12, 24, 48, 96, and 168 hours after the first and last dose and ATRC-101. Shown are the ATRC-101 blood serum concentrations measured by ELISA.

DETAILED DESCRIPTION

Terminology

As used in herein, the singular forms “a”, “an” and “the” include plural referents unless the content clearly dictates otherwise. Thus, for example, reference to “an antibody” optionally includes a combination of two or more such molecules, and the like.

The term “about” as used herein refers to the usual error range for the respective value readily known to the skilled person in this technical field, for example ±20%, ±10%, or ±5%, are within the intended meaning of the recited value.

As used herein, the term “antibody” means an isolated or recombinant binding agent that comprises the necessary variable region sequences to specifically bind an antigenic epitope. Therefore, an “antibody” as used herein is any form of antibody of any class or subclass or fragment thereof that exhibits the desired biological activity, e.g., binding a specific target antigen. Thus, it is used in the broadest sense and specifically covers a monoclonal antibody (including full-length monoclonal antibodies), human antibodies, chimeric antibodies, nanobodies, diabodies, multispecific antibodies (e.g., bispecific antibodies), and antibody fragments including but not limited to scFv, Fab, and the like so long as they exhibit the desired biological activity.

“Antibody fragments” comprise a portion of an intact antibody, for example, the antigen-binding or variable region of the intact antibody. Examples of antibody fragments include Fab, Fab', F(ab')2, and Fv fragments; diabodies; linear antibodies (e.g., Zapata et al., Protein Eng. 8(10): 1057-1062 (1995)); single-chain antibody molecules (e.g., scFv); and multispecific antibodies formed from antibody fragments. Papain digestion of antibodies produces two identical antigen-binding fragments, called “Fab” fragments, each with a single antigen-binding site, and a residual “Fc” fragment, a designation reflecting the ability to crystallize readily. Pepsin treatment yields an F(ab')2 fragment that has two antigen combining sites and is still capable of cross-linking antigen.

A “tumor-binding antibody” as used herein refers to an antibody that binds tumor tissue. In one embodiment, the tumor-binding antibody binds the tumor tissue through a binding interaction with an extracellular RNA-protein complex. “Extracellular RNA-protein complex” refers to a complex that is detected on the outside of tumor cells. The complex need not be integrated into the external surface of the cells, but in some embodiments, may be associated with the outside of the tumor cells as a conglomeration or aggregate of RNA and protein molecules interacting with the cell membrane, or otherwise present outside of the tumor cell. Although the extracellular RNA-protein complex is external to tumor cells, it may additionally be present internally in a cell. A “tumor-binding antibody” of the present disclosure exhibits preferential binding to tumor tissue compared to tumor-adjacent tissue (TAT), e.g., specific signal above noise is noted with enhanced reactivity apparent in tumor vs adjacent tissues. In some embodiments the tumor-binding antibody is an “anti-tumor antibody” that decreases rate of tumor growth, tumor size, invasion, and/or metastasis, via direct or indirect effects on tumor cells.

As used herein, “V-region” refers to an antibody variable region domain comprising the segments of Framework 1, CDR1, Framework 2, CDR2, and Framework 3, including CDR3 and Framework 4. The heavy chain V-region, $V_H$, is a consequence of rearrangement of a V-gene (HV), a D-gene (HD), and a J-gene (HJ), in what is termed V(D)J recombination during B-cell differentiation. The light chain V-region, $V_L$, is a consequence of rearrangement of a V-gene (LV) and a J-gene (LJ).

As used herein, “complementarity-determining region (CDR)” refers to the three hypervariable regions (HVRs) in each chain that interrupt the four “framework” regions established by the light and heavy chain variable regions. The CDRs are the primary contributors to binding to an epitope of an antigen. The CDRs of each chain are referred to as CDR1, CDR2, and CDR3, numbered sequentially starting from the N-terminus, and are also identified by the chain in which the particular CDR is located. Thus, for example, a $V_H$ CDR3 (HCDR3) is located in the variable domain of the heavy chain of the antibody in which it is found, whereas a $V_L$ CDR3 (LCDR3) is the CDR3 from the variable domain of the light chain of the antibody in which it is found. The term “CDR” is used interchangeably with “HVR” in this application when referring to CDR sequences.

The amino acid sequences of the CDRs and framework regions can be determined using various well known definitions in the art, e.g., Kabat, Chothia, international ImMunoGeneTics database (IMGT), and AbM (see, e.g., Chothia & Lesk, 1987, Canonical structures for the hypervariable regions of immunoglobulins. J. Mol. Biol. 196, 901-917; Chothia C. et al., 1989, Conformations of immunoglobulin hypervariable regions. Nature 342, 877-883; Chothia C. et al., 1992, structural repertoire of the human VH segments J. Mol. Biol. 227, 799-817; Al-Lazikani et al., J. Mol. Biol 1997, 273(4)). Definitions of antigen combining sites are also described in the following: Ruiz et al., IMGT, the international ImMunoGeneTics database. Nucleic Acids Res., 28, 219-221 (2000); and Lefranc, M.-P. IMGT, the international ImMunoGeneTics database. Nucleic Acids Res. January 1; 29(1):207-9 (2001); MacCallum et al, Antibody-antigen interactions: Contact analysis and binding site topography, J. Mol. Biol., 262 (5), 732-745 (1996); and Martin et al, Proc. Natl Acad. Sci. USA, 86, 9268-9272 (1989); Martin, et al, Methods Enzymol., 203, 121-153, (1991); Pedersen et al, Immunomethods, 1, 126, (1992); and Rees et al, In Sternberg M. J. E. (ed.), Protein Structure Prediction. Oxford University Press, Oxford, 141-172 1996). Reference to CDRs as determined by Kabat numbering are based, for example, on Kabat et al., Sequences of Proteins of Immunological Interest, 5th Ed. Public Health Service, National Institute of Health, Bethesda, Md. (1991)). Chothia CDRs are determined as defined by Chothia (see, e.g., Chothia and Lesk J. Mol. Biol. 196:901-917 (1987)).

An “Fc region” refers to the constant region of an antibody excluding the first constant region immunoglobulin domain. Thus, e.g., for human immunoglobulins, “Fc” refers to the last two constant region immunoglobulin domains of IgA, IgD, and IgG, and the last three constant region immunoglobulin domains of IgE and IgM, and the flexible hinge N-terminal to these domains. For IgA and IgM Fc may include the J chain. For IgG, Fc comprises immunoglobulin domains Cγ2 and Cγ3 and the hinge between Cγ1 and Cγ. It is understood in the art that the boundaries of the Fc region may vary, however, the human IgG heavy chain Fc region is usually defined to comprise residues C226 or P230 to its carboxyl-terminus, using the numbering according to the EU index as in Kabat et al. (1991, NIH Publication 91-3242, National Technical Information Service, Springfield, Va.). The term "Fc region" may refer to this region in isolation or this region in the context of an antibody or antibody fragment. "Fc region" includes naturally occurring allelic variants of the Fc region as well as modified Fc regions, e.g., that are modified to modulate effector function or other properties such as pharmacokinetics, stability or production properties of an antibody. Fc regions also include variants that do not exhibit alterations in biological function. For example, one or more amino acids can be deleted from the N-terminus or C-terminus of the Fc region of an immunoglobulin without substantial loss of biological function. Such variants can be selected according to general rules known in the art so as to have minimal effect on activity (see, e.g., Bowie, et al., *Science* 247:306-1310, 1990). For example, for IgG4 antibodies, a single amino acid substitution (S228P according to Kabat numbering; designated IgG4Pro) may be introduced to abolish the heterogeneity observed in recombinant IgG4 antibody (see, e.g., Angal, et al., *Mol Immunol* 30:105-108, 1993).

An "$EC_{50}$" as used herein in the context of an Fc receptor engagement assay, refers to the half maximal effective concentration, which is the concentration of an antibody that induces a response (signal generated in engagement assay) halfway between the baseline and maximum after a specified exposure time. Fc receptor engagement assays are further described herein in the "Variant Binding Activity" section. In some embodiments, the "fold over EC50" is determined by dividing the EC50 of a reference antibody by the $EC_{50}$ of the test antibody.

The term "equilibrium dissociation constant" abbreviated ($K_D$), refers to the dissociation rate constant ($k_d$, time$^{-1}$) divided by the association rate constant ($k_a$, time$^{-1}$ M$^{-1}$). Equilibrium dissociation constants can be measured using any method. Thus, in some embodiments antibodies of the present disclosure have a $K_D$ of less than about 50 nM, typically less than about 25 nM, or less than 10 nM, e.g., less than about 5 nM or than about 1 nM and often less than about 10 nM as determined by surface plasmon resonance analysis using a biosensor system such as a Biacore® system performed at 37° C. In some embodiments, an antibody of the present disclosure has a $K_D$ of less than $5\times10^{-5}$M, less than $10^{-5}$M, less than $5\times10^{-6}$ M, less than $10^{-6}$ M, less than $5\times10^{-7}$M, less than $10^{-7}$M, less than $5\times10^{-8}$M, less than $10^{-8}$M, less than $5\times10^{-9}$M, less than $10^{-9}$M, less than $5\times10^{-10}$ M, less than $10^{-10}$ M, less than $5\times10^{-11}$ M, less than $10^{-11}$, less than $5\times10^{-12}$M, less than $10^{-12}$M, less than $5\times10^{-13}$M, less than $10^{-13}$M, less than $5\times10^{-14}$M, less than $10^{-14}$M, less than $5\times10^{-15}$ M, or less than $10^{-15}$ M or lower as measured as a bivalent antibody. In the context of the present invention, an "improved" $K_D$ refers to a lower $K_D$. In some embodiments, an antibody of the present disclosure has a $K_D$ of less than $5\times10^{-5}$M, less than $10^{-5}$M, less than $5\times10^{-6}$M, less than $10^{-6}$M, less than $5\times10^{-7}$M, less than $10^{-7}$M, less than $5\times10^{-8}$M, less than $10^{-8}$M, less than $5\times10^{-9}$M, less than $10^{-9}$M, less than $5\times10^{-10}$ M, less than $10^{-10}$ M, less than $5\times10^{-11}$ M, less than $10^{-11}$, less than $5\times10^{-12}$ M, less than $10^{-12}$M, less than $5\times10^{-13}$ M, less than $10^{-13}$M, less than $5\times10^{-14}$ M, less than $10^{-14}$M, less than $5\times10^{-15}$M, or less than $10^{-15}$M or lower as measured as a monovalent antibody, such as a monovalent Fab. In some embodiments, an anti-tumor antibody of the present disclosure has $K_D$ less than 100 pM, e.g., or less than 75 pM, e.g., in the range of 1 to 100 pM, when measured by surface plasmon resonance analysis using a biosensor system such as a Biacore® system performed at 37° C. In some embodiments, an anti-tumor antibody of the present disclosure has $K_D$ of greater than 100 pM, e.g., in the range of 100-1000 pM or 500-1000 pM when measured by surface plasmon resonance analysis using a biosensor system such as a Biacore® system performed at 37° C.

The term "monovalent molecule" as used herein refers to a molecule that has one antigen-binding site, e.g., a Fab or scFv.

The term "bivalent molecule" as used herein refers to a molecule that has two antigen-binding sites. In some embodiments, a bivalent molecule of the present invention is a bivalent antibody or a bivalent fragment thereof. In some embodiments, a bivalent molecule of the present invention is a bivalent antibody. In some embodiments, a bivalent molecule of the present invention is an IgG. In general monoclonal antibodies have a bivalent basic structure. IgG and IgE have only one bivalent unit, while IgA and IgM consist of multiple bivalent units (2 and 5, respectively) and thus have higher valencies. This bivalency increases the avidity of antibodies for antigens.

The terms "monovalent binding" or "monovalently binds to" as used herein refer to the binding of one antigen-binding site to its antigen.

The terms "bivalent binding" or "bivalently binds to" as used herein refer to the binding of both antigen-binding sites of a bivalent molecule to its antigen. In some embodiments, both antigen-binding sites of a bivalent molecule share the same antigen specificity.

The term "valency" as used herein refers to the number of different binding sites of an antibody for an antigen. A monovalent antibody comprises one binding site for an antigen. A bivalent antibody comprises two binding sites for the same antigen.

The term "avidity" as used herein in the context of antibody binding to an antigen refers to the combined binding strength of multiple binding sites of the antibody. Thus, "bivalent avidity" refers to the combined strength of two binding sites.

The terms "identical" or percent "identity," in the context of two or more polypeptide sequences, refer to two or more sequences or subsequences that are the same or have a specified percentage of amino acid residues that are the same (e.g., at least 70%, at least 75%, at least 80%, 85%, 90%, 91%, 92%, 93%, 94%, 95%, 96%, 97%, 98%, 99%, or higher) identity over a specified region, e.g., the length of the two sequences, when compared and aligned for maximum correspondence over a comparison window or designated region. Alignment for purposes of determining percent amino acid sequence identity can be performed in various methods, including those using publicly available computer software such as BLAST, BLAST-2, ALIGN or Megalign (DNASTAR) software. Examples of algorithms that are suitable for determining percent sequence identity and sequence similarity the BLAST 2.0 algorithms, which are described in Altschul et al., Nuc. Acids Res. 25:3389-3402 (1977) and Altschul et al., J. Mol. Biol. 215:403-410 (1990). Thus, for purposes of this invention, BLAST 2.0 can be used with the default parameters to determine percent sequence identity.

The terms "corresponding to," "determined with reference to," or "numbered with reference to" when used in the context of the identification of a given amino acid residue in a polypeptide sequence, refers to the position of the residue of a specified reference sequence when the given amino acid sequence is maximally aligned and compared to the reference sequence. Thus, for example, an amino acid residue in a $V_H$ region polypeptide "corresponds to" an amino acid in the $V_H$ region of SEQ ID NO:1 when the residue aligns with the amino acid in SEQ ID NO:1 when optimally aligned to SEQ ID NO:1. The polypeptide that is aligned to the reference sequence need not be the same length as the reference sequence.

A "conservative" substitution as used herein refers to a substitution of an amino acid such that charge, polarity, hydropathy (hydrophobic, neutral, or hydrophilic), and/or size of the side group chain is maintained. Illustrative sets of amino acids that may be substituted for one another include (i) positively-charged amino acids Lys and Arg; and His at pH of about 6; (ii) negatively charged amino acids Glu and Asp; (iii) aromatic amino acids Phe, Tyr and Trp; (iv) nitrogen ring amino acids His and Trp; (v) aliphatic hydrophobic amino acids Ala, Val, Leu and Ile; (vi) hydrophobic sulfur-containing amino acids Met and Cys, which are not as hydrophobic as Val, Leu, and Ile; (vii) small polar uncharged amino acids Ser, Thr, Asp, and Asn (viii) small hydrophobic or neutral amino acids Gly, Ala, and Pro; (ix) amide-comprising amino acids Asn and Gln; and (xi) beta-branched amino acids Thr, Val, and Ile. Reference to the charge of an amino acid in this paragraph refers to the charge at pH 6-7.

The terms "nucleic acid" and "polynucleotide" are used interchangeably and as used herein refer to both sense and anti-sense strands of RNA, cDNA, genomic DNA, and synthetic forms and mixed polymers of the above. In particular embodiments, a nucleotide refers to a ribonucleotide, deoxynucleotide or a modified form of either type of nucleotide, and combinations thereof. The terms also include, but is not limited to, single- and double-stranded forms of DNA. In addition, a polynucleotide, e.g., a cDNA or mRNA, may include either or both naturally occurring and modified nucleotides linked together by naturally occurring and/or non-naturally occurring nucleotide linkages. The nucleic acid molecules may be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analogue, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.). The above term is also intended to include any topological conformation, including single-stranded, double-stranded, partially duplexed, triplex, hairpinned, circular and padlocked conformations. A reference to a nucleic acid sequence encompasses its complement unless otherwise specified. Thus, a reference to a nucleic acid molecule having a particular sequence should be understood to encompass its complementary strand, with its complementary sequence. The term also includes codon-optimized nucleic acids that encode the same polypeptide sequence.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. A "vector" as used here refers to a recombinant construct in which a nucleic acid sequence of interest is inserted into the vector. Certain vectors are capable of directing the expression of nucleic acids to which they are operatively linked. Such vectors are referred to herein as "expression vectors".

A "substitution," as used herein, denotes the replacement of one or more amino acids or nucleotides by different amino acids or nucleotides, respectively.

An "isolated" nucleic acid refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

"Isolated nucleic acid encoding an antibody or fragment thereof" refers to one or more nucleic acid molecules encoding antibody heavy or light chains (or fragments thereof), including such nucleic acid molecule(s) in a single vector or separate vectors, and such nucleic acid molecule(s) present at one or more locations in a host cell.

The terms "host cell," "host cell line," and "host cell culture" are used interchangeably and refer to cells into which exogenous nucleic acid has been introduced, including the progeny of such cells. Thus, a host cell is a recombinant host cells and includes the primary transformed cell and progeny derived therefrom without regard to the number of passages.

A polypeptide "variant," as the term is used herein, is a polypeptide that typically differs from one or more polypeptide sequences specifically disclosed herein in one or more substitutions, deletions, additions and/or insertions.

The term "cancer cell" or "tumor cell" as used herein refers to a neoplastic cell. The term includes cells from tumors that are benign as well as malignant. Neoplastic transformation is associated with phenotypic changes of the tumor cell relative to the cell type from which it is derived. The changes can include loss of contact inhibition, morphological changes, and unregulated cell growth, "Inhibiting growth of a tumor" and "inhibiting growth of a cancer" as used herein are interchangeable and refer to slowing growth and/or reducing the cancer cell burden of a patient that has cancer. "Inhibiting growth of a cancer" thus includes killing cancer cells, as well as decreasing the rate of tumor growth, tumor size, invasion, and/or metastasis by direct or indirect effects on tumor cells.

As used herein, "therapeutic agent" refers to an agent that when administered to a patient suffering from a disease, in a therapeutically effective dose, will cure, or at least partially arrest the symptoms of the disease and complications associated with the disease.

Antibodies that Bind to a Tumor

In one aspect, provided herein are antibodies that bind to tumor tissue through a binding interaction with an extracellular RNA-protein complex. The extracellular-RNA protein complex is further described below in the section entitled "Antibody Binding Target".

Heavy and light chain variable region sequences of illustrative tumor-binding antibodies of the present disclosure are provided in Tables 1A and 2A.

Positions of residues in heavy chain variable regions are specified herein with reference to any one of the $V_H$ region sequences (SEQ ID NOS:77-122, 1333-1526, and 1725) of Table 1A and 2A, all of which are 140 amino acids in length.

Positions of residues in light chain variable regions are specified herein with reference to any one of the 110-amino acid $V_L$ region sequences (SEQ ID NOS:123-168, 1527-1720, and 1726) shown in Tables 1A and 2A.

Position 140, as numbered with respect to $V_H$ region sequences presented in Tables 1A and 2A, and position 110 of the $V_L$ region sequences presented in Tables 1A and 2A are considered to be the last amino acids of the $V_H$ and $V_L$ regions, respectively, according to EU index numbering. In a human IgG format (e.g., IgG1, IgG2, IgG3, or IgG4), the subsequent residue is termed the "junction codon", and is natively encoded by the junction of the final 3' base of the variable region gene (HJ or LJ) with the first two 5' bases of the constant region gene (heavy or light), and exhibits amino acid variation due to variation in the final 3' base of HJ and LJ. The human heavy chain junction codon can natively be Ala, Ser, Pro, or Thr, and is usually an Ala. The human kappa chain junction codon can natively be Arg or Gly, and is usually an Arg. The human lambda chain junction codon can natively be Gly, Ser, Arg, or Cys, and is usually a Ser or Gly.

CDRs as shown in Table 1B and Table 2B are defined by IMGT and Kabat. The heavy chain CDRs encompass amino acid residues from amino acid residues 26-35 (HCDR1), 50-68 (HCDR2) and 99-129 (HCDR3). The light chain CDRs encompass amino acid residues from amino acid residues 23-35 (LCDR1), 51-57 (LCDR2), and 90-100 (LCDR3). The numbering of the residues correspond to the positions in the $V_H$ and $V_L$ sequences in Tables 1A and 2A. The $V_H$ CDRs as listed in Table 1B and Table 2B are defined as follows: HCDR1 is defined by combining Kabat and IMGT; HCDR2 is defined by Kabat; and the HCDR3 is defined by IMGT. The $V_L$ CDRs as listed in Table 1B and Table 2B are defined by Kabat. As known in the art, numbering and placement of the CDRs can differ depending on the numbering system employed. It is understood that disclosure of a variable heavy and/or variable light sequence includes the disclosure of the associated CDRs, regardless of the numbering system employed.

Using AIP-160470 as a reference sequence, FIG. 37 shows the numbering of the residues in the AIP-160470 $V_H$ and $V_L$ sequences using IMGT, Kabat, and Chothia numbering systems.

The CDRs as defined using the IMGT numbering system are:

HCDR1: 27-38 (excluding positions 31-34)
HCDR2: 56-65
HCDR3: 105-117 (including 18 insertions between 111 and 112)
LCDR1: 27-38 (excluding positions 31-34)
LCDR2: 56-65 (excluding positions 58-64) and
LCDR3: 105-117 (excluding positions 111-112).

Accordingly, the corresponding IMGT CDRs for AIP-160470 are:

```
HCDR1:
                              (SEQ ID NO: 1763)
GFTFSKAW

HCDR2:
                              (SEQ ID NO: 1764)
IKSVTDGETT

HCDR3:
                                (SEQ ID NO: 21)
TSSFCCRGGSCPSHDTSYCGGQYKSYYYMDV
```

-continued

```
LCDR1:
                              (SEQ ID NO: 1765)
SSNIGSSS

LCDR2:
KNN

LCDR3:
                                (SEQ ID NO: 68)
STWDDSLSVRV.
```

The CDRs as defined using the Kabat numbering system are:

HCDR1: 31-35
HCDR2: 50-65 (including insertions of 52a, 52b, and 52c)
HCDR3: 95-102 (including insertions of 100a-100u)
LCDR1: 24-34 (including insertions of 27a and 27b)
LCDR2: 50-56
LCDR3: 89-97 (including insertions of 95a and 95b).

Accordingly, the corresponding KABAT CDRs for AIP-160470 are:

```
HCDR1:
                              (SEQ ID NO: 1766)
KAWMS

HCDR2:
                                 (SEQ ID NO: 9)
RIKSVTDGETTDYAAPVKG

HCDR3:
                              (SEQ ID NO: 1767)
SFCCRGGSCPSHDTSYCGGQYKSYYYMDV

LCDR1:
                                (SEQ ID NO: 48)
SGSSSNIGSSSVS

LCDR2:
                                (SEQ ID NO: 59)
KNNQRPS

LCDR3:
                                (SEQ ID NO: 68)
STWDDSLSVRV
```

The CDRs defined using the Chothia numbering system are:

HCDR1: 26-32;
HCDR2: 52-56 (including insertions of 52a, 52b, and 52c)
HCDR3: 95-102 (including insertions of 100a-100u)
LCDR1: 24-34 (including insertions of 30a and 30b)
LCDR2: 50-56
LCDR3: 89-97 (including insertions of 95a and 95b.

Accordingly, the corresponding Chothia CDRs for AIP-160470 are:

```
HCDR1:
                              (SEQ ID NO: 1768)
GFTFSKA

HCDR2:
                              (SEQ ID NO: 1769)
KSVTDGET

HCDR3:
                              (SEQ ID NO: 1767)
SFCCRGGSCPSHDTSYCGGQYKSYYYMDV

LCDR1:
                                (SEQ ID NO: 48)
SGSSSNIGSSSVS
```

-continued

LCDR2:

(SEQ ID NO: 59)

KNNQRPS

LCDR3:

(SEQ ID NO: 68)

STWDDSLSVRV $V_H$ Regions

In some embodiments, a tumor-binding antibody of the present invention that binds to an extracellular RNA-protein complex, e.g., that has activity in an FcγRIIa engagement assay, has one, two, or three CDRs of a $V_H$ sequence as shown in Table 1A or Table 2A. In some embodiments, the tumor-binding antibody has at least one mutation and no more than 10, 20, 30, 40 or 50 mutations in the $V_H$ amino acid sequences compared to a $V_H$ sequence set forth in any one of SEQ ID NOS:77-122 or 1333-1526 or 1725. In some embodiments, the $V_H$ amino acid sequence may comprise 1, 2, 3, 4, 5, 6, 7, 8, 9, or 10 amino acid insertions or deletions compared to a $V_H$ sequence set forth in any one of SEQ ID NOS:77-122 or 1333-1526 or 1725. In some embodiments, the $V_H$ amino acid sequence may comprise a deletion or insertion, e.g., a 1, 2, 3, 4, or 5 amino acid deletions or insertions, relative to a CDR sequence shown in Table 1B or Table 2B. In some embodiments, the $V_H$ amino acid sequence may comprise a 1-amino acid or 2-amino acid deletion or insertion relative to a CDR sequence shown in Table 1B or Table 2B. In some embodiments, the $V_H$ region comprises a CDR1 having 1 or 2 substitutions relative to a CDR1 sequence of any one of SEQ ID NOS:1-8 or 169-362. In some embodiments, an HCDR1 has 3 or 4 substitutions relative to a CDR1 sequence of any one of SEQ ID NOS:1-8 or 169-362. In some embodiments, the $V_H$ region comprises a CDR2 that has 1, 2, 3, or 4 substitutions relative to a CDR2 sequence of any one of SEQ ID NOS:9-19 or 363-556. In some embodiments, the $V_H$ region has 5, 6, 7, or 8 substitutions relative to a CDR2 sequence of any one of SEQ ID NOS:9-19 or 363-556. In some embodiments, the $V_H$ region comprises a CDR3 that has 1, 2, 3, or 4 substitutions relative to a CDR3 sequence of any one of SEQ ID NOS:20-47 or 557-750 or 1727. In some embodiments, the $V_H$ region has 5, 6, 7, or 8 substitutions relative to a CDR3 sequence of any one of SEQ ID NOS:20-47 or 557-750 or 1727. In some embodiments, the $V_H$ region has 9, 10, 11, 12, 13, or 14 substitutions relative to a CDR3 of any one of SEQ ID NOS:20-47 or 557-750 or 1727. In some embodiments, a tumor-binding antibody of the present invention comprises a CDR1, CDR2, and CDR3, each having at least 80% identity to a CDR1, CDR2, and CDR3 as shown in Table 1B or 2B In some embodiments, a tumor-binding antibody of the present invention comprises a CDR1, CDR2, and CDR3, each having at least 90% identity to a CDR1, CDR2, and CDR3 as shown in Table 1B or Table 2B. In some embodiments, an anti-tumor antibody of the present invention comprises a CDR1, CDR2, and CDR3 as shown in Table 1B or Table 2B. In some embodiments, a tumor-binding antibody of the present invention comprises an HCDR1, HCDR2, and HCDR3 of an antibody designated as AIP-158623, AIP-155066, AIP-136538, AIP-166120, AIP-133645, AIP-187893, AIP-142079, AIP-160470, AIP-104188, AIP-157397, AIP-165430, AIP-189526, AIP-192482, AIP-122563, or AIP-171142 in Table 1.

In some embodiments, a $V_H$ region of a tumor-binding antibody of the present invention has a solvent exposure of each CDR side chain, in terms of square Angstroms, as specified in this paragraph, based on a Fab crystal structure of an illustrative antibody. Classification as buried, intermediate, or exposed is based on cutoff values as follows: less than about 10 $Ang^2$, about 10-50 $Ang^2$, or greater than about 50 $Ang^2$, respectively. The positions are determined with reference to any one of the $V_H$ region sequences provided in Table 1A or Table 2A. Thus, in some embodiments, an anti-tumor antibody of the invention comprises a CDR1 in which positions 26, 27, 28, 29, 30, and 31 are exposed; position 32 is buried; position 33 is exposed; and positions 34 and 35 are intermediate. In some embodiments, an anti-tumor antibody of the invention comprises a CDR2 in which position 50 is intermediate; position 51 is exposed; position 53 is buried; positions 54, 55, 56, 57, 58, 59, and 60 are exposed; position 61 is intermediate; and positions 62, 63, 64, 65, 66, 67, and 68 are exposed. In some embodiments, an anti-tumor antibody of the invention comprises a CDR3 in which position 99 is exposed; position 100 is buried; position 101 is intermediate; positions 102, 103, and 104 are buried; positions 105, 106, 107, and 108 are exposed; positions 109 and 110 are buried; position 111 is intermediate; positions 112 and 113 are exposed; position 114 is intermediate; positions 115 and 116 are exposed; position 117 is intermediate; position 118 is exposed; position 119 is intermediate; position 120 is exposed; position 121 is intermediate; positions 122 and 123 are exposed; position 124 is intermediate; and positions 125, 126, 127, 128, and 129 are exposed. In some embodiments, a residue that is classified as "buried" comprises a substitution, relative to a CDR set forth in CDR of Table 1B or Table 2B, that is a conservative substitution that maintains charge and approximate size to maintain antibody conformation. In some embodiments, a residue classified as "exposed" is substituted, e.g., with a conservative substitution, or with a residue that provides improved binding to cancer cells compared to the parent sequence as shown in Table 1A or Table 2A.

In some embodiments, the HCDR3 of a tumor-binding antibody as described herein has at least 60% identity, at least 70% identity, at least 80% identity, at least 85%, at least 90% identity, or at least 95% identity to any one of the HCDR3 sequences shown in Table 1B or Table 2B. In some embodiments, at least two, three, or all four of the cysteine residues in a HCDR3 sequence as described herein are conserved in a variant. In further embodiments, the HCDR3 is at least 27, 28, 29, or 30 amino acids in length. In typical embodiments, the HCDR3 is 31 amino acids in length.

In some embodiments, the FR1 region of a $V_H$ region of a tumor-binding antibody as described herein has at least 80% or at least 90% identity to the FR1 sequence from positions 1 to 25 of a $V_H$ region of any one of SEQ ID NOS:77-122 or 1333-1526 or 1725. In some embodiments, the FR1 region has at least 95% identity to the FR1 sequence from position 1 to 25 of a $V_H$ region of any one of SEQ ID NOS:77-122 or 1333-1526 or 1725. In some embodiments, the FR1 comprises the amino acid sequence from position 1 to 25 of a $V_H$ region of any one of SEQ ID NOS:77-122 or 1333-1526 or 1725.

In some embodiments, the FR2 region of a $V_H$ region of a tumor-binding antibody as described herein as at least 80% or at least 90% identity to the FR2 sequence from position 36 to 49 of a $V_H$ region of any one of SEQ ID NOS:77-122 or 1333-1526 or 1725. In some embodiments, the FR2 region has at least 95% identity to the FR2 sequence from position 36 to 49 of a $V_H$ region of any one of SEQ ID NOS:77-122 or 1333-1526 or 1725. In some embodiments, the FR2 comprises the amino acid sequence from position 36 to 49 of a $V_H$ region of any one of SEQ ID NOS:77-122 or 1333-1526 or 1725.

In some embodiments, the FR3 region of a $V_H$ region of a tumor-binding antibody of the invention has at least 80% or at least 90% identity to the FR3 sequence from position 69 to 98 of a $V_H$ region of any one of SEQ ID NOS:77-122 or 1333-1526 or 1725. In some embodiments, the FR3 region has at least 95% identity to the FR3 sequence from position 69 to 98 of a $V_H$ region of any one of SEQ ID NOS:77-122 or 1333-1526 or 1725. In some embodiments, the FR3 comprises the amino acid sequence from position 69 to 98 of a $V_H$ region of any one of SEQ ID NOS:77-122 or 1333-1526 or 1725.

In some embodiments, the FR4 region a $V_H$ region of comprises the amino acid sequence from position 130 to 140 of a $V_H$ region of any one of SEQ ID NOS:77-122 or 1333-1526 or 1725. In some embodiments, the FR4 region comprises a substitution at one or two of the positions 130 to 140 relative to the corresponding sequence of a $V_H$ region of any one of SEQ ID NOS:77-122 or 1333-1526 or 1725.

In some embodiments, a tumor-binding antibody of the invention comprises a heavy chain CDR1 sequence GFTFSKAWM(S/T) (SEQ ID NO: 1749). In some embodiments, the CDR1 comprises GFTFSKAWMS (SEQ ID NO:1). In alternative embodiments, the CDR1 comprises GFTFSKAWMT (SEQ ID NO:8). In some embodiments, 1, 2, or 3 amino acids are substituted relative to the sequence GFTFSKAWMS (SEQ ID NO:1) or GFTFSKAWMT (SEQ ID NO:8). For example, in some embodiments, the CDR1 comprises N at position 30, N at position 31; and/or Y at position 33. In some embodiments, the CDR1 has at least 60% identity, or at least 70% identity, at least 80% identity, or at least 90% identity to the sequence GFTFSKAWMS (SEQ ID NO:1) or GFTFSKAWMT (SEQ ID NO:8).

In some embodiments, a tumor binding antibody of the invention comprises a heavy chain HCDR2 sequence RIKS(V/T)(T/S)(D/E)G(E/G)(I/T)T(D/E)YAAPVKG (SEQ ID NO: 1770). In some embodiments, the HCDR2 comprises RIKS(V/T)(T/S)(D/E)G(E/G)(I/T)TDVAAPVKG (SEQ ID NO: 1750). In some embodiments, the HCDR2 comprises RIKSVTDGETTDYAAPVKG (SEQ ID NO:9). In some embodiments, the HCDR2 comprises RIKSVTEGETTDYAAPVKG (SEQ ID NO:17). In some embodiments, the HCDR2 comprises RIKSTSDGGITDYAAPVKG (SEQ ID NO:16). In some embodiments, 1, 2, 3, 4, 5, 6, 7, or 8 amino acids are substituted relative to the sequence RIKSVTDGETTDYAAPVKG (SEQ ID NO:9); or 1, 2, 3, 4, 5, 6, 7, or 8 amino acids are substituted relative to the sequence RIKSVTEGETTDYAAPVKG (SEQ ID NO:17). For example, in some embodiments, the HCDR2 comprises a substituted sequence having one or more of the following positions: position 51 is V; position 54 is K or T; position 55 is S; position 56 is S; position 58 is G; position 59 is I; position 60 is K; or position 61 is E. In some embodiments, 1, 2, 3, 4, 5, 6, 7, or 8 amino acids are substituted relative to the sequence RIKSVTEGETTDYAAPVKG (SEQ ID NO:17). For example, in some embodiments, the HCDR2 comprises a substituted sequence in which position 51 is V; position 54 is V, K or T; position 55 is T, position 58 is E; position 59 is T; position 60 is K; and/or position 61 is E. In some embodiments, if the HCDR2 comprises a sequence in which position 56 is S, the HCDR1 comprises a W at position 33. In some embodiments, the HCDR2 has at least 60% identity, or at least 70% identity, to the sequence RIKSVTDGETTDYAAPVKG (SEQ ID NO:9); or at least 60% identity, or at least 70% identity, to the sequence RIKSVTEGETTDYAAPVKG (SEQ ID NO:17). In some embodiments, the CDR2 sequence has at least 80% identity, or at least 90% identity, to the sequence RIKSVTDGETTDYAAPVKG (SEQ ID NO:9) or RIKSVTEGETTDYAAPVKG (SEQ ID NO:17).

In some embodiments, a tumor-binding antibody comprises a $V_H$ CDR3 sequence T(S/T)SFCCRGG(R/S)CPS(H/R)DTS(Y/F)CGG(Q/S)(Y/D)(K/N/S)(S/R)YYYMDV (SEQ ID NO: 1747). In some embodiments, the HCDR3 comprises any one of the HCDR3 sequences shown in Table 1B or Table 2B. In some embodiments, the HCDR3 comprises a sequence as shown in Table 1B or Table 2B in which 1, 2, 3, 4, 5, 6, 7, 8, or 9 amino acids are substituted relative to the CDR3 sequence. For example, in some embodiments, the HCDR3 comprises V at position 99, T at position 100, R at position 108, D at position 111, R at position 112, Y at position 116, and/or S at position 120. In some embodiments, a $V_H$ CDR3 comprises a sequence T(S/T)SFCCRGG(R/S)CPS(H/R)DTS(Y/F)CGG(Q/S)YKSYYYMDV (SEQ ID NO: 1751), T(S/T)SFCCRGG(R/S)CPS(H/R)DTS(Y/F)CGG(Q/S)DSRYYYMDV (SEQ ID NO: 1752), T(S/T)SFCCRGG(R/S)CPS(H/R)DTS(Y/F)CGG(Q/S)YNRYYYMDV (SEQ ID NO: 1753), T(S/T)SFCCRGG(R/S)CPS(H/R)DTS(Y/F)CGG(Q/S)YNSYYYMDV (SEQ ID NO: 1754), or T(S/T)SFCCRGG(R/S)CPS(H/R)DTS(Y/F)CGG(Q/S)DKRYYYMDV (SEQ ID NO: 1755). In some embodiments, a $V_H$ CDR3 comprises a sequence T(S/T)SFCCRGGSCPSHDTS(Y/F)CGG(Q/S)YKSYYYMDV (SEQ ID NO: 1758), T(S/T)SFCCRGGSCPSHDTS(Y/F)CGG(Q/S)DSRYYYMDV (SEQ ID NO: 1759), T(S/T)SFCCRGGSCPSHDTS(Y/F)CGG(Q/S)YNRYYYMDV (SEQ ID NO: 1760), or T(S/T)SFCCRGGSCPSHDTS(Y/F)CGG(Q/S)DKRYYYMDV (SEQ ID NO: 1761).

In some embodiments, a tumor-binding antibody of the invention comprises a heavy chain CDR1 sequence GFTFSKAWM(S/T) (SEQ ID NO: 1749). In some embodiments, the HCDR1 comprises GFTFSKAWMS (SEQ ID NO:1). In alternative embodiments, the HCDR1 comprises GFTFSKAWMT (SEQ ID NO:8). In some embodiments, 1, 2, or 3 amino acids are substituted relative to the sequence GFTFSKAWMS (SEQ ID NO:1) or GFTFSKAWMT (SEQ ID NO:8). For example, in some embodiments, the HCDR1 comprises N at position 30, N at position 31; and/or Y at position 33. In some embodiments, the HCDR1 has at least 60% identity, or at least 70% identity, at least 80% identity, or at least 90% identity to the sequence GFTFSKAWMS (SEQ ID NO:1) or GFTFSKAWMT (SEQ ID NO:8).

In some embodiments, a tumor-binding antibody of the invention comprises a heavy chain CDR2 sequence RIKS(V/T)(T/S)(D/E)G(E/G)(I/T)T(D/E)YAAPVKG (SEQ ID NO: 1770). In some embodiments, the HCDR2 comprises RIKS(V/T)(T/S)(D/E)G(E/G)(I/T)TDYAAPVKG (SEQ ID NO: 1750). In some embodiments, the HCDR2 comprises RIKSVTDGETTDYAAPVKG (SEQ ID NO:9). In some embodiments, the HCDR2 comprises RIKSVTEGETTDYAAPVKG (SEQ ID NO:17). In some embodiments, the CDR2 comprises RIKSTSDGGITDYAAPVKG (SEQ ID NO:16). In some embodiments, 1, 2, 3, 4, 5, 6, 7, or 8 amino acids are substituted relative to the sequence RIKSVTDGETTDYAAPVKG (SEQ ID NO:9); or 1, 2, 3, 4, 5, 6, 7, or 8 amino acids are substituted relative to the sequence RIKSVTEGETTDYAAPVKG (SEQ ID NO:17). For example, in some embodiments, the HCDR2 comprises a substituted sequence having one or more of the following positions: position 51 is V; position 54 is K or T; position 55 is S; position 56 is S; position 58 is G; position 59 is I; position 60 is K; or position 61 is E. In some embodiments, 1, 2, 3, 4, 5, 6, 7, or 8 amino acids are substituted relative to the sequence RIKSVTEGETTDYAAPVKG (SEQ ID NO:17). For example, in some embodiments, the HCDR2 comprises a substituted sequence in which position 51 is V; position 54 is V, K or T; position 55 is T, position 58 is E; position 59 is T; position 60 is K; and/or position 61 is E. In some embodiments, if the HCDR2 comprises a sequence in which position 56 is S, the HCDR1 comprises a W at position 33. In some embodiments, the HCDR2 has at least 60% identity, or at least 70% identity, to the sequence RIKSVTDGETTDYAAPVKG (SEQ ID NO:9); or at least 60% identity, or at least 70% identity, to the sequence RIKSVTEGETTDYAAPVKG (SEQ ID NO:17). In some embodiments, the CDR2 sequence has at least 80% identity, or at least 90% identity, to the sequence RIKSVTDGETTDYAAPVKG (SEQ ID NO:9) or RIKSVTEGETTDYAAPVKG (SEQ ID NO:17).

In some embodiments, an anti-tumor antibody comprises a $V_H$ CDR3 sequence T(S/T)SFCCRGG(R/S)CPS(H/R)DTS(Y/F)CGG(Q/S)(Y/D)(K/N/S)(S/R)YYYMDV (SEQ ID NO: 1747). In some embodiments, the CDR3 comprises any one of the CDR3 sequences shown in Table 1 or Table 2. In some embodiments, the CDR3 comprises a CDR3 sequence as shown in Table 1 or Table 2 in which 1, 2, 3, 4, 5, 6, 7, 8, or 9 amino acids are substituted relative to the CDR3 sequence. For example, in some embodiments, the CDR3 comprises V at position 99, T at position 100, R at position 108, D at position 111, R at position 112, Y at position 116, and/or S at position 120. In some embodiments, a $V_H$ CDR3 comprises a sequence T(S/T)SFCCRGG(R/S)CPS(H/R)DTS(Y/F)CGG(Q/S)YKSYYYMDV (SEQ ID NO: 1751), T(S/T)SFCCRGG(R/S)CPS(H/R)DTS(Y/F)CGG(Q/S)DSRYYYMDV (SEQ ID NO: 1752), T(S/T)SFCCRGG(R/S)CPS(H/R)DTS(Y/F)CGG(Q/S)YNRYYYMDV (SEQ ID NO: 1753), T(S/T)SFCCRGG(R/S)CPS(H/R)DTS(Y/F)CGG(Q/S)YNSYYYMDV (SEQ ID NO: 1754), or T(S/T)SFCCRGG(R/S)CPS(H/R)DTS(Y/F)CGG(Q/S)DKRYYYMDV (SEQ ID NO: 1755). In some embodiments, a $V_H$ CDR3 comprises a sequence

```
                                      (SEQ ID NO: 1758)
T(S/T)SFCCRGGSCPSHDTS(Y/F)CGG(Q/S)YKSYYYMDV,

                                      (SEQ ID NO: 1759)
T(S/T)SFCCRGGSCPSHDTS(Y/F)CGG(Q/S)DSRYYYMDV,

                                      (SEQ ID NO: 1760)
T(S/T)SFCCRGGSCPSHDTS(Y/F)CGG(Q/S)YNRYYYMDV,
or

                                      (SEQ ID NO: 1761)
T(S/T)SFCCRGGSCPSHDTS(Y/F)CGG(Q/S)DKRYYYMDV.
```

$V_L$ Regions

In some embodiments, a tumor-binding antibody of the present invention that binds to an extracellular RNA-protein complex, e.g., that has activity in an FcγRIIa engagement assay, has one, two, or three CDRs of a $V_L$ sequence as shown in Table 1A or Table 2A. In some embodiments, the tumor-binding antibody has at least one mutation and no more than 10, 20, 30, 40 or 50 mutations in the $V_L$ amino acid sequences compared to a $V_L$ sequence of any one of SEQ ID NOS:123-168 or 1527-1720 or 1726. In some embodiments, the $V_L$ amino acid sequence may comprise 1, 2, 3, 4, 5, 6, 7, 8, 9, or 10 amino acid insertions or deletions compared to a $V_L$ sequence of any one of SEQ ID NOS: 123-168 or 1527-1720 or 1726. In some embodiments, the $V_L$ amino acid sequence may comprise a deletion or insertion, e.g., a 1, 2, 3, 4, 5, 6, or 7 amino acid deletion or insertion, relative to a CDR sequence shown in Table 1. In some embodiments, the $V_L$ amino acid sequence may comprise a 1-amino acid or 2-amino acid deletion or insertion relative to a CDR sequence shown in Table 1B or Table 2B. In some embodiments, the $V_L$ region comprises a CDR1 having 1 or 2 substitutions in relative to a CDR1 sequence of any one of SEQ ID NOS:48-58 or 751-944 or 1741. In some embodiments, a CDR1 has 3, 4, or 5 substitutions relative to a CDR1 sequence of any one of SEQ ID NOS: 48-58 or 751-944 or 1741. In some embodiments, the $V_L$ region comprises a CDR2 that has 1 or 2; or 1, 2, or 3; substitutions relative to the CDR2 sequence of any one of SEQ ID NOS:59-67 or 945-1138. In some embodiments, the $V_L$ region comprises a CDR3 that has 1, 2, or 3; or 1, 2, 3, or 4; substitutions relative to a CDR3 sequence of any one of SEQ ID NOS:68-76 or 1139-1332. In some embodiments, an anti-tumor antibody of the present invention comprises a CDR1, CDR2, and CDR3, each having at least 70% identity to a CDR1, CDR2, and CDR3 as shown in Table 1 or Table 2. In some embodiments, an anti-tumor antibody of the present invention comprises a CDR1, CDR2, and CDR3, each having at least 80% identity to a CDR1, CDR2, and CDR3 as shown in Table 1B or Table 2B. In some embodiments, an anti-tumor antibody of the present invention comprises a CDR1, CDR2, and CDR3 as shown in Table 1B or Table 2B.

In some embodiments, a tumor-binding antibody of the present invention comprises a CDR1, CDR2, and CDR3 of an antibody designated as AIP-158623, AIP-155066, AIP-136538, AIP-166120, AIP-133645, AIP-187893, AIP-142079, AIP-160470, AIP-104188, AIP-157397, AIP-165430, AIP-189526, AIP-192482, AIP-122563, or AIP-171142 in Table 1A.

In some embodiments, a $V_L$ region of a tumor-binding antibody of the present invention has a solvent exposure of each CDR side chain, in terms of square Angstroms, as specified in this paragraph, which is based on a Fab crystal structure of an illustrative antibody. Classification as buried, intermediate, or exposed is based on cutoff values as follows: less than about 10 $Ang^2$, about 10-50 $Ang^2$, or greater than about 50 $Ang^2$, respectively. The positions are determined with reference to any one of the $V_L$ region sequences provided in Table 1A. Thus, in some embodiments, an anti-tumor antibody $V_L$ of the invention comprises a CDR1 in which position 23 is exposed; position 24 is intermediate; positions 25 and 26 are exposed; positions 27 and 28 are intermediate; positions 29, 30, and 31 are exposed; positions 32, 33, and 34 are intermediate; and position 35 is exposed. In some embodiments, an anti-tumor antibody $V_L$ of the invention comprises a CDR2 in which positions 51, 52, 53, 54, 55, 56, and 57 are exposed. In some embodiments, an anti-tumor antibody $V_L$ of the invention comprises a CDR3 in which position 90 is exposed; position 91 is buried, position 92 is exposed; position 93 is buried, positions 94, 95, 96, and 97 are exposed; position 99 is intermediate; and position 100 is exposed. In some embodiments, a residue that is classified as "buried" comprises a substitution, relative to a CDR of Table 1B or Table 2B, that is a conservative substitution that maintains charge and approximate size to maintain antibody conformation. In some embodiments a residue classified as "exposed" is substituted, e.g., with a conservative substitution, or with a residue that provides improved binding to cancer cells compared to a sequence as shown in Table 1A or Table 2.

In some embodiments, a tumor-binding antibody of the invention comprises a light chain CDR1 sequence SGSSSNIGSSSVS (SEQ ID NO:48). In some embodiments, 1, 2, 3, 4, or 5 amino acids are substituted relative to the sequence SGSSSNIGSSSVS (SEQ ID NO:48). For example, in some embodiments, position 28 is Y or H. In some embodiments, position 30 is E. In some embodiments, position 32 is N. In some embodiments, position 33 is Y or F. In some embodiments, position 35 is D or E. In some embodiments, the CDR1 has at least 60% identity, at least 70% identity, at least 80% identity, or at least 90% identity to the sequence SGSSSNIGSSSVS (SEQ ID NO:48).

In some embodiments, a tumor-binding antibody of the invention comprises a light chain CDR2 sequence (K/R)(N/D)(N/D)QRPS (SEQ ID NO: 1771). In some embodiments, the CDR2 comprises a CDR2 sequence as shown in Table 1 or Table 2. In some embodiments, the CDR2 comprises a CDR2 sequence KNNQRPS (SEQ ID NO:59). In some embodiments, 1, 2, or 3 amino acid are substituted relative to the sequence KNNQRPS (SEQ ID NO:59). For example, in some embodiments, position 51 is R, position 52 is D, and/or position 53 is D. In some embodiments, the CDR2 sequence has at least 60% or at least 70% identity to the sequence KNNQRPS (SEQ ID NO:59).

In some embodiments, a tumor-binding antibody of the invention comprises a $V_L$ CDR3 sequence STWD(D/E)SLSV(R/W)V (SEQ ID NO: 1772). In some embodiments, the CDR3 sequence comprises STWD(D/E)SLSVRV (SEQ ID NO: 1762). In some embodiments, the CDR3 comprises a CDR3 sequence as shown in Table 1 or Table 2. In some embodiments, the CDR3 sequence comprises STWDDSLSVRV (SEQ ID NO:68) or STWDESLSVRV (SEQ ID NO:73). In some embodiments, 1, 2, or 3 amino acids are substituted relative to the sequence STWDDSLSVRV (SEQ ID NO:68) or STWDESLSVRV (SEQ ID NO:73). For example, in some embodiments position 90 is A, position 91 is I, and/or position 97 is G.

In some embodiments, the FR1 region of a $V_L$ region of a tumor-binding antibody of the invention has at least 80% or at least 90% identity to the FR1 sequence from position 1 to 22 off a $V_L$ region sequence of Table 1. In some embodiments, the FR1 region has at least 95% identity to the FR1 sequence from position 1 to 22 of a $V_L$ region sequence of Table 1. In some embodiments, the FR1 comprises the amino acid sequence from positions 1 to 22 of a $V_L$ region sequence of Table 1.

In some embodiments, the FR2 region of a $V_L$ region of a tumor-binding antibody of the invention has at least 80% or at least 90% identity to the FR2 sequence from position 36 to 50 off a $V_L$ region sequence of Table 1. In some embodiments, the FR2 region has at least 95% identity to the FR2 sequence from position 36 to 50 of a $V_L$ region sequence of Table 1. In some embodiments, the FR2 comprises the amino acid sequence from positions 36 to 50 of a $V_L$ region sequence of Table 1.

In some embodiments, the FR3 region of a $V_L$ region of a tumor-binding antibody of the invention has at least 80% or at least 90% identity to the FR3 sequence from position 58 to 89 f a $V_L$ region sequence of Table 1. In some embodiments, the FR3 region has at least 90% identity, or at least 95% identity to the FR3 sequence from position 58 to 89 off a $V_L$ region sequence of Table 1 In some embodiments, the FR3 comprises the amino acid sequence from position 58 to 89 of a $V_L$ region sequence of Table 1.

In some embodiments, the FR4 region a $V_H$ region of comprises the amino acid sequence from position 101 to 110 of a $V_L$ region sequence of Table 1. In some embodiments, the FR4 region comprises a substitution at one or two of the positions 101 to 110 relative to the corresponding sequence of a $V_L$ region sequence of Table 1.

In some embodiments, a tumor-binding antibody of the present invention comprises a $V_L$ region CDR1, CDR2, and/or a CDR3 as described in the preceding paragraphs is this section. In some embodiments one or two of the $V_L$ CDR sequences comprise a CDR sequence as shown in Table 1. In some embodiments, an anti-tumor antibody of the present invention comprises a $V_L$ region CDR1, CDR2 and/or a CDR3 as described in the preceding paragraphs in this section and has at least 70% identity, at least 75% identity, at least 80% identity, or at least 85% identity, at least 90% identity, or at least 95% identity to any one of the $V_L$ sequences as shown in Table 1. In some embodiments, the anti-tumor antibody comprises a CDR1, CDR2, and CDR3 as shown in Table 1 and has at least 70% identity, at least 75% identity, at least 80% identity, or at least 85% identity, at least 90% identity, or at least 95% identity to any one of the $V_L$ sequences as shown in Table 1.

In some embodiments, a tumor-binding antibody comprises an LCDR1, LCDR2, and LCDR3 of an antibody designated as AIP-158623, AIP-155066, AIP-136538, AIP-166120, AIP-133645, AIP-187893, AIP-142079, AIP-160470, AIP-104188, AIP-157397, AIP-165430, AIP-189526, AIP-192482, AIP-122563, or AIP-171142 and comprises at least 80%, or at least 90%, identity to the corresponding $V_L$ sequence shown in Table 1, or comprises the $V_L$ sequence of the corresponding $V_L$ sequence in Table 1.

Illustrative Antibodies

In some embodiments, the provided herein is an antibody that binds to a tumor through a binding interaction with an extracellular RNA-protein complex, wherein the antibody comprises heavy and light chain CDRs shown in Table 1 or Table 2. In some embodiments, the antibody comprises an HCDR1 of any one of SEQ ID NOS:1-8 or 169-362, or a variant thereof in which 1, 2, 3, 4, or 5 amino acids are substituted relative to the sequence, an HCDR2 of any one of SEQ ID NOS:9-19 or 363-556, or a variant thereof in which 1, 2, 3, 4, or 5 amino acids are substituted relative to the sequence; an HCDR3 of any one of SEQ ID NOS:20-47 or 557-750 or 1727 or a variant thereof in which 1, 2, 3, 4, 5, 6, 7, 8, 9, or 10 amino acids are substituted relative to the sequence; an LCDR1 of any one of SEQ ID NOS:48-58 or 751-944 or 1741, or a variant thereof in which 1, 2, 3, 4, or 5 amino acids are substituted relative to the sequence; an LCDR2 of any one of SEQ ID NOS:59-67 or 945-1138, or a variant thereof in which 1, 2, or 3 amino acids are substituted relative to the sequence; and an LCDR3 of any one of SEQ ID NOS:68-76 or 1139-1332, or a variant thereof in which 1, 2, 3, 4, or 5 amino acids are substituted relative to the sequence. In some embodiments, at least 1 or 2 of the substitutions are conservative substitutions. In some embodiments, at least 50% or at least 60%, at least 70%, at least 80%, or at least 90% of the substitutions, relative to the referenced CDR sequence in Table 1 or Table 2, are conservative substitutions.

In some embodiments, the antibody comprises an HCDR1 of any one of SEQ ID NOS:1-8 or 169-362, or a variant thereof in which 1 or 2 amino acids are substituted relative to the sequence, an HCDR2 of any one of SEQ ID NOS:9-19 or 363-556, or a variant thereof in which 1 or 2 amino acids are substituted relative to the sequence; an HCDR3 of any one of SEQ ID NOS:20-47 or 557-750 ro 1727 or a variant thereof in which 1, 2, or 3; or in which 1 or 2; amino acids are substituted relative to the sequence; an LCDR1 of any one of SEQ ID NOS:48-58 or 751-944 or 1741, or a variant thereof in which 1 or 2 amino acids are substituted relative to the sequence; an LCDR2 of any one of SEQ ID NOS: 59-67 or 945-1138, or a variant thereof in which 1 or 2 amino acids are substituted relative to the sequence; and an LCDR3 of any one of SEQ ID NOS:68-76 or 1139-1332, or a variant thereof in which 1 or 2 amino acids are substituted relative to the sequence. In some embodiments, at least 1 or 2 of the substitutions are conservative substitutions.

In some embodiments, the provided herein is an antibody that binds to a tumor through a binding interaction with an extracellular RNA-protein complex, wherein antibody comprises six CDRs of an antibody designated in Table 1A or Table 2A; or a variant of the antibody in which at least one CDR, at least two CDRs, at least three CDRs, at least four CDRs, at least five CDRs, or all six CDRs have 1 to 2 amino acid substitutions compared to the corresponding CDR of the antibody shown in Table 1A or 2A.

In some embodiments, provided herein is a tumor-binding antibody that binds to an extracellular RNA-protein complex, wherein the antibody comprises CDRs according to the following formula. For each CDR, an "X" residue is numbered by its position in the CDR, e.g., $X_3$ is in the third position of CDR.

(a) an HCDR1 sequence G(F/Y)$X_3X_4$(A/S)$X_6$A(W/Y)$X_9$(S/T) (SEQ ID NO:1734), wherein $X_3$ is D, T or V; $X_4$ is A, F, or Y; $X_6$ is A, H, K, M, N or R; and $X_9$ is F, M, or Y;

(b) an HCDR2 sequence (F/R)I(K/Q)(A/S)$X_5X_6X_7$(A/G)$X_9X_{10}$T(D/E)(A/S)(P/S)(K/Q) (SEQ ID NO:1735), wherein $X_5$ is A, N, T, or V; $X_6$ is D, H, Q, S or T; $X_7$ is D, E, or N; $X_9$ is E, G, H, K or Q; and $X_{10}$ is A, I, Q or T;

(c) an HCDR3 sequence (I/T)(S/T)$X_3$(F/Y)$X_5$C$X_7$(G/S)$X_9X_{10}$C$X_{12}X_{13}X_{14}$(D/E)$X_{16}$S$X_{18}X_{19}X_{20}X_{21}X_{22}X_{23}X_{24}X_{25}$(F/Y) (F/Y)$X_{28}X_{29}$(D/N)$X_{31}$ (SEQ ID NO:1736), wherein $X_3$ is A, P, S, or T; $X_5$ is A, C, or S; $X_7$ is H, L, Q, or R; $X_9$ is A, G, K, or N; $X_{10}$ is A, N, Q, R, or S; $X_{12}$ is A, L, or P; $X_{13}$ is A, N, or S; $X_{14}$ is H, Q, R, or S; $X_{16}$ is N, Q, or T; $X_{18}$ is F, M, or Y; $X_{19}$ is C, S, or V; $X_{20}$ is A, G, or N; $X_{21}$ is A, G, or N; $X_{22}$ is Q, S, or Y; $X_{23}$ is D, F, N, S, or Y; $X_{24}$ is A, K, N, P, Q, or S; $X_{25}$ is D, K, Q, R, or S; $X_{28}$ is F, L, W, or Y; $X_{29}$ is F, M, or V; and $X_{31}$ is I, P, or V;

(d) an LCDR1 sequence $X_1$G(A/S)$X_4$(S/T)(D/N)I(G/Q)(H/S)$X_{10}X_{11}$(TN)$X_{13}$ (SEQ ID NO:1737), wherein $X_1$ is H, S, or T; $X_4$ is E, K, P, or S; $X_{10}$ is A, H, N, S, or T; $X_{11}$ is A, D, S, T, or Y; and $X_{13}$ is A, L, S, T or Y;

(e) an LCDR2 sequence $X_1$(D/N)$X_3X_4$(Q/R)(A/P)$X_7$ (SEQ ID NO:1738), wherein $X_1$ is A, H, K, M, N, or R; $X_3$ is N, S, or T; $X_4$ is A, L, Q, or Y; and $X_7$ is L, Q, S, or Y; and (f) an LCDR3 sequence (A/S)(S/T)(F/W)(D/N)$X_5X_6X_7X_8$(I/V)$X_{10}$(I/V) (SEQ ID NO:1739), wherein $X_5$ is D, E, or N; $X_6$ is A, D, Q, or S; $X_7$ is L, N, or S; $X_8$ is L, N, S, or T; and $X_{10}$ is H, K, Q, R, or W. In some embodiments, each heavy or light chain CDR of the antibody differs from a corresponding heavy or light chain CDR in Table 1A or Table 2A by no more than two amino acids, or by no more than one amino acid.

In some embodiments, provided herein is an antibody that binds to a tumor through a binding interaction with an extracellular RNA-protein complex, wherein the antibody comprises six CDRs of an antibody shown in Table 1A or Table 2A, or a variant thereof in which at least one, two, three, four, five, or all six CDRs comprise 1 or 2 amino acid substitutions relative to the corresponding CDR sequence in Table 1B or Table 2B. In some embodiments, provided herein is an antibody that binds to a tumor through a binding interaction with an extracellular RNA-protein complex, wherein the antibody comprises six CDRs of an antibody shown as shown in Table 1A or Table 2A, or a variant thereof in which at least one, two, three, four, five, or all six CDRs comprise 1 or 2 amino acid substitutions relative to the corresponding CDR sequence in Table 1B or Table 2B. In some embodiments, the antibody comprises six CDRs of an antibody designated as AIP-192482, AIP-171142, AIP-165430, AIP-189526, AIP-122563, AIP-158623, AIP-155066, AIP-166120, AIP-133645, AIP-187893, AIP-142079, AIP-160470, AIP-102396, AIP-150055, AIP-167084, AIP-185304, AIP-134770, AIP-141887, AIP-196203, AIP-128195, AIP-116579, AIP-192329, AIP-197809, AIP-142489, AIP-167726, AIP-199834, AIP-143179, AIP-195587, AIP-153462, AIP-115363, AIP-151090, AIP-168083, AIP-161082, AIP-114196, AIP-189338, AIP-183190, AIP-110143, AIP-147176, AIP-134312, AIP-128243, AIP-156172, AIP-147389, AIP-124314, AIP-185291, AIP-135247, AIP-113513, AIP-102299, AIP-179097, AIP-109343, AIP-119622, AIP-191735, AIP-157078, AIP-153475, AIP-133650, AIP-190915, AIP-167400, AIP-109729, AIP-151709, AIP-136628, AIP-101601, AIP-146871, AIP-170053, AIP-199483, AIP-162041, AIP-180675, AIP-183133, AIP-191470, AIP-151167, AIP-106633, AIP-102624, AIP-109484, AIP-126080, AIP-161571, AIP-163039, AIP-101235, AIP-182061, AIP-181246, AIP-192216, AIP-171912, AIP-172872, AIP-167833, AIP-190051, AIP-145518, AIP-167533, AIP-112580, AIP-143155, AIP-119664, AIP-190526, AIP-114403, AIP-156760, AIP-103803, AIP-195588, AIP-145722, AIP-178251, AIP-116142, AIP-183350, AIP-127108, AIP-128147, AIP-109510, AIP-104086, AIP-143132, AIP-170105, AIP-169636, AIP-152243, AIP-138776, AIP-103817, AIP-130491, AIP-188155, AIP-167246, AIP-106139, AIP-198351, AIP-159326, AIP-192275, AIP-190761, AIP-166832, AIP-148062, AIP-129145, AIP-111240, AIP-153888, AIP-130915, AIP-109048, AIP-170569, AIP-154873, AIP-159037, AIP-186826, AIP-156514, AIP-157122, AIP-173276, AIP-150485, AIP-166847, AIP-124013, AIP-126285, AIP-168605, AIP-190274, AIP-136060, AIP-180422, AIP-166722, AIP-127782, AIP-189473, AIP-192571, AIP-112328, AIP-125258, AIP-150199, AIP-125062, AIP-177193, AIP-115388, AIP-107759, AIP-170221, AIP-143369, AIP-189475, AIP-102833, AIP-157045, AIP-175775, AIP-154181, AIP-125984, AIP-160829, AIP-184744, AIP-128136, AIP-181273, AIP-153125, or AIP-131972, or a variant thereof in which at least one, two, three, four, five, or all six CDRs comprise 1 or 2 amino acid substitutions relative to the corresponding CDR sequence in Table 2B.

In some embodiments, provided herein is a tumor-binding antibody that binds to an extracellular RNA-protein complex, wherein the antibody comprises CDRs according to the following formula. For each CDR, an "X" residue is numbered by its position in the CDR, e.g., $X_3$ is in the third position of CDR.

(a) an HCDR1 sequence G(F/Y)$X_3X_4$(A/S)$X_6$A(W/Y)(F/M)(S/T) (SEQ ID NO: 1742), wherein $X_3$ is D, T or V; $X_4$ is A, F, or Y; and $X_6$ is A, H, K, M, or N;

(b) an HCDR2 sequence RIK(A/S)$X_5X_6$(D/N)(A/G)$X_9X_{10}$(D/E)(A/S)(P/S)(K/Q) (SEQ ID NO: 1743), wherein $X_5$ is A, N, T, or V; $X_6$ is D, H, Q, S or T; $X_9$ is E, G, H, K or Q; and $X_{10}$ is A, I, Q, or T;

(c) an HCDR3 sequence (I/T)(S/T)$X_3$(F/Y)CC$X_7$(G/S)$X_9X_{10}$C$X_{12}$(N/S)$X_{14}$(D/E)TS(F/Y)C$X_{20}$(G/N)$X_{22}X_{23}X_{24}$, $X_{25}$(F/Y)Y$X_{28}X_{29}$(D/N)$X_{31}$ (SEQ ID NO: 1744), wherein $X_3$ is A, P, or S; $X_7$ is H, L, Q, or R; $X_9$ is A, G, K, or N; $X_{10}$ is A, N, Q, R, or S; $X_{12}$ is A, L, or P; $X_{14}$ is H, Q, R, or S; $X_{20}$ is A, G, or N; $X_{22}$ is Q, S, or Y; $X_{23}$ is D, F, N, or Y; $X_{24}$ is A, K, N, P, or Q; $X_{25}$ is D, Q, R, or S; $X_{28}$ is F, L, W, or Y; $X_{29}$ is F, M, or V; and $X_{31}$ is I, P, or V;

(d) an LCDR1 sequence (S/T)G(A/S)$X_4$(S/T)(D/N)IG(H/S)$X_{10}X_{11}$(TN)$X_{13}$ (SEQ ID NO: 1745), wherein $X_4$ is K, P, or S, $X_{10}$ is A, N, S, or T; $X_{11}$ is A, S, T, or Y; and $X_{13}$ is A, S, T or Y;

(e) an LCDR2 sequence $X_1$(D/N)$X_3X_4$(Q/R)(A/P)$X_7$ (SEQ ID NO: 1738), wherein $X_1$ is A, H, K, M, N, or R; $X_3$ is N, S, or T; $X_4$ is A, L, Q, or Y, and $X_7$ is L, Q, S, or Y; and (f) an LCDR3 sequence (A/S)(S/T)W(D/N)$X_5X_6X_7X_8$(I/V)$X_{10}$(I/V) (SEQ ID NO: 1746), wherein $X_5$ is D, E, or N, $X_6$ is A, D, Q, or S, $X_7$ is L, N, or S; $X_8$ is L, N, S, or T; and $X_{10}$ is H, K, Q, or R.

In some embodiments, provided herein are tumor-binding antibodies comprising a $V_H$ having at least 70% identity, at least 75% identity, at least 80% identity, or at least 85% identity, at least 90% identity, or at least 95% identity to the amino acid sequence of a $V_H$ region of any one of SEQ ID NOS:77-122 or 1333-1526 or 1725. In some embodiments, provided herein are anti-tumor antibodies comprising a $V_L$ having at least 70% identity, at least 75% identity, at least 80% identity, or at least 85% identity, at least 90% identity, or at least 95% identity to the amino acid sequence of a $V_L$ region of any one of SEQ ID NOS:123-168 or 1527-1720 or 1726.

In some embodiments, a tumor-binding antibody comprises a $V_H$ comprising an amino acid sequence of one of SEQ ID NOS:77-122 or 1333-1526; or a $V_L$ comprising an amino acid sequence of any one of SEQ ID NOS:123-168 or 1527-1720.

In some embodiments, a tumor-binding antibody of the present invention comprises the $V_H$ and the $V_L$ of any one of the antibodies designated by AIP number (an "AIP antibody") in Table 1A or Table 2A. In some embodiments, the tumor-binding antibody is a variant of the antibody in which the $V_H$ has at least 85% identity, or at least 90% identity; or at least 95% identity; and a $V_L$ having at least 85% identity, or at least 90% identity; or at least 95% identity to the $V_H$ sequence of the AIP antibody as shown in Table 1A or Table 2A and the $V_L$ has at least 85% identity, or at least 90% identity; or at least 95% identity to the $V_L$ sequence of the AIP antibody as shown in Table 1A or Table 2A. In some embodiments, the variant antibody has no more than ten mutations, or no more than nine mutations, no more than eight mutations, or no more than seven mutations in total in the heavy and light chain CDR sequences compared to the CDR sequence of the AIP antibody. In some embodiments, the antibody has six, five, four, three, two or one mutation in total in the heavy and light chain CDR sequences compared to the CDR sequences of the AIP antibody. In some embodiments, all of the mutations are substitutions relative to sequence of the AIP antibody as shown in Table 1.

In some embodiments, a tumor-binding antibody of the invention has the CDRs of an antibody designated as AIP-158623, AIP-155066, AIP-136538, AIP-166120, AIP-133645, AIP-187893, AIP-142079, AIP-160470, AIP-104188, AIP-157397, AIP-165430, AIP-189526, AIP-192482, AIP-122563, or AIP-171142. In some embodiments, the antibody additionally has at least 80%, or at least 90%, identity to the corresponding $V_H$ and $V_L$ sequences shown in Table 1.

Antibodies that Exhibit Anti Tumor Activity

In one aspect, provided herein are antibodies that exhibit inhibitory effects on tumors, including decreasing rate of tumor growth, size, tumor invasion and/or metastasis. Such antibodies exhibit anti-tumor effects in vivo, e.g., when administered to subjects that has a tumor having an extracellular RNA-protein complex. In some embodiments, a $V_H$ region or a $V_L$ region of such an antibody has at least two, three, four, five, or six, or more modifications, e.g., substitutions, relative to the illustrative antibody sequences as described herein. In some embodiments, an anti-tumor antibody comprises an antibody as shown in Table 1A (AIP designation AIP-101235, AIP-127782, AIP-189473, AIP-192571, AIP-125258, AIP-150199, AIP-115388, AIP-143369, AIP-157045, AIP-175775, AIP-154181, AIP-125984, AIP-160829, AIP-184744, AIP-128136, AIP-181273, AIP-153125, AIP-160470, AIP-192482, AIP-171142, AIP-157397, AIP-165430, AIP-189526, AIP-122563, AIP-158623, AIP-155066, AIP-136538, AIP-166120, AIP-133645, AIP-187893, AIP-142079, AIP-104188, AIP-106042, AIP-100196, AIP-180675, AIP-170105, AIP-126080, AIP-161571, AIP-181246, AIP-192216, AIP-168605, AIP-172872, AIP-190051, AIP-167533, AIP-112580, AIP-136060), or a variant thereof as described herein. In some embodiments, an anti-tumor antibody comprises the six CDRs of an antibody as shown in Table 1B (AIP designation AIP-101235, AIP-127782, AIP-189473, AIP-192571, AIP-125258, AIP-150199, AIP-115388, AIP-143369, AIP-157045, AIP-175775, AIP-154181, AIP-125984, AIP-160829, AIP-184744, AIP-128136, AIP-181273, AIP-153125, AIP-160470, AIP-192482, AIP-171142, AIP-157397, AIP-165430, AIP-189526, AIP-122563, AIP-158623, AIP-155066, AIP-136538, AIP-166120, AIP-133645, AIP-187893, AIP-142079, AIP-104188, AIP-106042, AIP-100196, AIP-180675, AIP-170105, AIP-126080, AIP-161571, AIP-181246, AIP-192216, AIP-168605, AIP-172872, AIP-190051, AIP-167533, AIP-112580, AIP-136060), or a variant thereof as described herein.

$V_H$ Regions

In some embodiments, an anti-tumor antibody of the present invention has one, two, or three CDRs of a $V_H$ sequence of as shown in Table 1. In some embodiments, the anti-tumor antibody has at least one mutation and no more than 10, 20, 30, 40 or 50 mutations in the $V_H$ amino acid sequence compared to a $V_H$ sequence of any one of SEQ ID NOS:77-122. In some embodiments, the $V_H$ amino acid sequence may comprise 1, 2, 3, 4, 5, 6, 7, 8, 9, or 10 amino acid insertions or deletions compared to a $V_H$ sequence of any one of SEQ ID NOS:77-122. In some embodiments, the $V_H$ amino acid sequence may comprise a deletion or insertion, e.g., a 1, 2, 3, 4, or 5 amino acid deletions or insertions, relative to a CDR sequence of a $V_H$ region of any one of SEQ ID NOS:77-122. In some embodiments, the $V_H$ amino acid sequence may comprise a 1-amino acid or 2-amino acid deletion or insertion relative to a CDR sequence of a $V_H$ region of any one of SEQ ID NOS:77-122. In some embodiments, the $V_H$ region comprises an HCDR1 having 1 or 2 substitutions in relative to an HCDR1 sequence of any one of SEQ ID NOS:1-8. In some embodiments, an HCDR1 has 3 or 4 substitutions relative to an HCDR1 sequence of any one of SEQ ID NOS:1-8. In some embodiments, the $V_H$ region comprises an HCDR2 that has 1, 2, 3, or 4 substitutions relative to an HCDR2 sequence of any one of SEQ ID NOS:9-19. In some embodiments, the $V_H$ region has 5, 6, 7, or 8 substitutions relative to an HCDR2 sequence of any one of SEQ ID NOS:9-19. In some embodiments, the $V_H$ region comprises an HCDR3 that has 1, 2, 3, or 4 substitutions relative to an HCDR3 sequence of any one of SEQ ID NOS:20-47. In some embodiments, the $V_H$ region has 5, 6, 7, or 8 substitutions relative to an HCDR3 sequence of any one of SEQ ID NOS:20-47. In some embodiments, the $V_H$ region has 9, 10, 11, 12, 13, or 14 substitutions relative to an HCDR3 sequence of any one of SEQ ID NOS:20-47. In some embodiments, an anti-tumor antibody of the present invention comprises a $V_H$ region CDR1, CDR2, and CDR3, each having at least 80% identity to the corresponding CDR1, CDR2, and CDR3 of a $V_H$ region of any one of SEQ ID NOS:77-122. In some embodiments, an anti-tumor antibody of the present invention comprises a CDR1, CDR2, and CDR3, each having at least 90% identity to the corresponding CDR1, CDR2, and CDR3 of a $V_H$ region of any one of SEQ ID NOS:77-122. In some embodiments, an anti-tumor antibody of the present invention comprises a CDR1, CDR2, and CDR3 of a $V_H$ region of any one of SEQ ID NOS:77-122. In some embodiments, a tumor-binding antibody of the present invention comprises a CDR1, CDR2, and CDR3 of an antibody designated as AIP-158623, AIP-155066, AIP-136538, AIP-166120, AIP-133645, AIP-187893, AIP-142079, AIP-160470, AIP-104188, AIP-157397, AIP-165430, AIP-189526, AIP-192482, AIP-122563, or AIP-171142 in Table 1A.

In some embodiments, a $V_H$ region of anti-tumor antibody of the present invention has a solvent exposure of each CDR side chain, in terms of square Angstroms, as specified in this paragraph, based on a Fab crystal structure of an illustrative antibody. Classification as buried, intermediate, or exposed is based on cutoff values as follows: less than about 10 $Ang^2$, about 10-50 $Ang^2$, or greater than about 50 $Ang^2$, respectively. The positions are determined with reference to any one of the $V_H$ region sequences of SEQ ID NOS:77-122 of Table 1A. Thus, in some embodiments, an anti-tumor antibody of the invention comprises a CDR1 in which positions 26, 27, 28, 29, 30, and 31 are exposed; position 32 is buried; position 33 is exposed; and positions 34 and 35 are intermediate. In some embodiments, an anti-tumor antibody of the invention comprises a CDR2 in which position 50 is intermediate; position 51 is exposed; position 53 is buried; positions 54, 55, 56, 57, 58, 59, and 60 are exposed; position 61 is intermediate; and positions 62, 63, 64, 65, 66, 67, and 68 are exposed. In some embodiments, an anti-tumor antibody of the invention comprises a CDR3 in which position 99 is exposed; position 100 is buried; position 101 is intermediate; positions 102, 103, and 104 are buried; positions 105, 106, 107, and 108 are exposed; positions 109 and 110 are buried; position 111 is intermediate; positions 112 and 113 are exposed; position 114 is intermediate; positions 115 and 116 are exposed; position 117 is intermediate; position 118 is exposed; position 119 is intermediate; position 120 is exposed; position 121 is intermediate; positions 122 and 123 are exposed; position 124 is intermediate; and positions 125, 126, 127, 128, and 129 are exposed. In some embodiments, a residue that is classified as "buried" comprises a substitution, relative to a CDR of a $V_H$ region of any one of SEQ ID NOS:77-122, that is a conservative substitution that maintains charge and approximate size to maintain antibody conformation. In some embodiments a residue classified as "exposed" is substituted, e.g., with a conservative substitution, or with a residue that provides improved binding to cancer cells compared to a parent antibody of Table 1A.

In some embodiments, the HCDR3 of an anti-tumor antibody as described herein has at least 60% identity, at least 70% identity, at least 80% identity, at least 85%, at least 90% identity, or at least 95% identity to any one of the HCDR3 sequences SEQ ID NOS:20-47. In some embodiments, at least two, three, or all four of the cysteine residues in a HCDR3 sequence as described herein are conserved in a variant. In further embodiments, the HCDR3 is at least 27, 28, 29, or 30 amino acids in length. In typical embodiments, the HCDR3 is 31 amino acids in length.

In some embodiments, the FR1 region of a $V_H$ region of an anti-tumor antibody as described herein has at least 80% or at least 90% identity to the FR1 sequence from positions 1 to 25 of a $V_H$ region of any one of SEQ ID NOS:77-122. In some embodiments, the FR1 region has at least 95% identity to the FR1 sequence from position 1 to 25 of a $V_H$ region of any one of SEQ ID NOS:77-122. In some embodiments, the FR1 comprises the amino acid sequence from position 1 to 25 of a $V_H$ region of any one of SEQ ID NOS:77-122.

In some embodiments, the FR2 region of a $V_H$ region of an anti-tumor antibody as described herein as at least 80% or at least 90% identity to the FR2 sequence from position 36 to 49 of a $V_H$ region of any one of SEQ ID NOS:77-122. In some embodiments, the FR2 region has at least 95% identity to the FR2 sequence from position 36 to 49 of a $V_H$ region of any one of SEQ ID NOS:77-122. In some embodiments, the FR2 comprises the amino acid sequence from position 36 to 49 of a $V_H$ region of any one of SEQ ID NOS:77-122.

In some embodiments, the FR3 region of a $V_H$ region of an anti-tumor antibody of the invention has at least 80% or at least 90% identity to the FR3 sequence from position 69 to 98 of a $V_H$ region of any one of SEQ ID NOS:77-122. In some embodiments, the FR3 region has at least 95% identity to the FR3 sequence from position 69 to 98 of a $V_H$ region of any one of SEQ ID NOS:77-122. In some embodiments, the FR3 comprises the amino acid sequence from position 69 to 98 of a $V_H$ region of any one of SEQ ID NOS:77-122.

In some embodiments, the FR4 region a $V_H$ region of comprises the amino acid sequence from position 130 to 140 of a $V_H$ region of any one of SEQ ID NOS:77-122. In some embodiments, the FR4 region comprises a substitution at one or two of the positions 130 to 140 relative to the corresponding sequence of a $V_H$ region of any one of SEQ ID NOS:77-122.

In some embodiments, an anti-tumor antibody of the invention comprises a heavy chain CDR1 sequence GFTFSKAWM(S/T) (SEQ ID NO: 1749). In some embodiments, the CDR1 comprises GFTFSKAWMS (SEQ ID NO:1). In alternative embodiments, the CDR1 comprises GFTFSKAWMT (SEQ ID NO:8). In some embodiments, 1, 2, or 3 amino acids are substituted relative to the sequence GFTFSKAWMS (SEQ ID NO:1) or GFTFSKAWMT (SEQ ID NO:8). For example, in some embodiments, the CDR1 comprises N at position 30, N at position 31; and/or Y at position 33. In some embodiments, the CDR1 has at least 60% identity, or at least 70% identity, at least 80% identity, or at least 90% identity to the sequence GFTFSKAWMS (SEQ ID NO:1) or GFTFSKAWMT (SEQ ID NO:8).

In some embodiments, an anti-tumor antibody of the invention comprises a heavy chain CDR2 sequence RIKS(V/T)(T/S)(D/E)G(E/G)(I/T)T(D/E)YAAPVKG (SEQ ID NO: 1770). In some embodiments, the CDR2 comprises RIKS(V/T)(T/S)(D/E)G(E/G)(I/T)TDYAAPVKG (SEQ ID NO: 1750). In some embodiments, the CDR2 comprises RIKSVTDGETTDYAAPVKG (SEQ ID NO:9). In some embodiments, the CDR2 comprises RIKSVTEGETTDYAAPVKG (SEQ ID NO:17). In some embodiments, the CDR2 comprises RIKSTSDGGITDYAAPVKG (SEQ ID NO:16).

In some embodiments, 1, 2, 3, 4, 5, 6, 7, or 8 amino acids are substituted relative to the sequence RIKSVTDGETTDYAAPVKG (SEQ ID NO:9); or 1, 2, 3, 4, 5, 6, 7, or 8 amino acids are substituted relative to the sequence RIKSVTEGETTDYAAPVKG (SEQ ID NO:17). For example, in some embodiments, the CDR2 comprises a substituted sequence having one or more of the following positions: position 51 is V; position 54 is K or T; position 55 is S; position 56 is S; position 58 is G; position 59 is I; position 60 is K; or position 61 is E. In some embodiments, 1, 2, 3, 4, 5, 6, 7, or 8 amino acids are substituted relative to the sequence RIKSVTEGETTDYAAPVKG (SEQ ID NO:17). For example, in some embodiments, the CDR2 comprises a substituted sequence in which position 51 is V; position 54 is V, K or T; position 55 is T, position 58 is E; position 59 is T; position 60 is K; and/or position 61 is E. In some embodiments, if the CDR2 comprises a sequence in which position 56 is S, the CDR1 comprises a W at position 33. In some embodiments, the CDR2 has at least 60% identity, or at least 70% identity, to the sequence RIKSVTDGETTDYAAPVKG (SEQ ID NO:9); or at least 60% identity, or at least 70% identity, to the sequence RIKSVTEGETTDYAAPVKG (SEQ ID NO:17). In some embodiments, the CDR2 sequence has at least 80% identity, or at least 90% identity, to the sequence RIKSVTDGETTDYAAPVKG (SEQ ID NO:9) or RIKSVTEGETTDYAAPVKG (SEQ ID NO:17).

In some embodiments, an anti-tumor antibody comprises a V$_H$ CDR3 sequence T(S/T)SFCCRGG(R/S)CPS(H/R)DTS(Y/F)CGG(Q/S)(Y/D)(K/N/S)(S/R)YYYMDV (SEQ ID NO: 1747). In some embodiments, the CDR3 comprises any one of the CDR3 sequences shown in Table 2. In some embodiments, the CDR3 comprises a CDR3 sequence as shown in Table 2 in which 1, 2, 3, 4, 5, 6, 7, 8, or 9 amino acids are substituted relative to the Table 2 CDR3 sequence. For example, in some embodiments, the CDR3 comprises V at position 99, T at position 100, R at position 108, D at position 111, R at position 112, Y at position 116, and/or S at position 120. In some embodiments, a V$_H$ CDR3 comprises a sequence T(S/T)SFCCRGG(R/S)CPS(H/R)DTS(Y/F)CGG(Q/S)YKSYYYMDV (SEQ ID NO: 1751), T(S/T)SFCCRGG(R/S)CPS(H/R)DTS(Y/F)CGG(Q/S) DSRYYYMDV (SEQ ID NO: 1752), T(S/T)SFCCRGG(R/S)CPS(H/R)DTS(Y/F)CGG(Q/S)YNRYYYMDV (SEQ ID NO: 1753), T(S/T)SFCCRGG(R/S)CPS(H/R)DTS(Y/F)CGG(Q/S)YNSYYYMDV (SEQ ID NO: 1754), or T(S/T)SFCCRGG(R/S)CPS(H/R)DTS(Y/F)CGG(Q/S) DKRYYYMDV (SEQ ID NO: 1755). In some embodiments, a V$_H$ CDR3 comprises a sequence

```
                                              (SEQ ID NO: 1758)
T(S/T)SFCCRGGSCPSHDTS(Y/F)CGG(Q/S)YKSYYYMDV,

                                              (SEQ ID NO: 1759)
T(S/T)SFCCRGGSCPSHDTS(Y/F)CGG(Q/S)DSRYYYMDV,

                                              (SEQ ID NO: 1760)
T(S/T)SFCCRGGSCPSHDTS(Y/F)CGG(Q/S)YNRYYYMDV,
or

                                              (SEQ ID NO: 1761)
T(S/T)SFCCRGGSCPSHDTS(Y/F)CGG(Q/S)DKRYYYMDV.
```

In some embodiments, an anti-tumor antibody of the invention comprises a heavy chain CDR1 sequence GFTFSKAWM(S/T) (SEQ ID NO: 1749). In some embodiments, the CDR1 comprises GFTFSKAWMS (SEQ ID NO:1). In alternative embodiments, the CDR1 comprises GFTFSKAWMT (SEQ ID NO:8). In some embodiments, 1, 2, or 3 amino acids are substituted relative to the sequence GFTFSKAWMS (SEQ ID NO:1) or GFTFSKAWMT (SEQ ID NO:8). For example, in some embodiments, the CDR1 comprises N at position 30, N at position 31; and/or Y at position 33. In some embodiments, the CDR1 has at least 60% identity, or at least 70% identity, at least 80% identity, or at least 90% identity to the sequence GFTFSKAWMS (SEQ ID NO:1) or GFTFSKAWMT (SEQ ID NO:8).

In some embodiments, an anti-tumor antibody of the invention comprises a heavy chain CDR2 sequence RIKS(V/T)(T/S)(D/E)G(E/G)(I/T)T(D/E)YAAPVKG (SEQ ID NO: 1770). In some embodiments, the CDR2 comprises RIKS(V/T)(T/S)(D/E)G(E/G)(I/T)TDYAAPVKG (SEQ ID NO: 1750). In some embodiments, the CDR2 comprises RIKSVTDGETTDYAAPVKG (SEQ ID NO:9). In some embodiments, the CDR2 comprises RIKSVTEGETTDYAAPVKG (SEQ ID NO:17). In some embodiments, the CDR2 comprises RIKSTSDGGITDYAAPVKG (SEQ ID NO:16). In some embodiments, 1, 2, 3, 4, 5, 6, 7, or 8 amino acids are substituted relative to the sequence RIKSVTDGETTDYAAPVKG (SEQ ID NO:9); or 1, 2, 3, 4, 5, 6, 7, or 8 amino acids are substituted relative to the sequence RIKSVTEGETTDYAAPVKG (SEQ ID NO:17). For example, in some embodiments, the CDR2 comprises a substituted sequence having one or more of the following positions: position 51 is V; position 54 is K or T; position 55 is S; position 56 is S; position 58 is G; position 59 is I; position 60 is K; or position 61 is E. In some embodiments, 1, 2, 3, 4, 5, 6, 7, or 8 amino acids are substituted relative to the sequence RIKSVTEGETTDYAAPVKG (SEQ ID NO:17). For example, in some embodiments, the CDR2 comprises a substituted sequence in which position 51 is V; position 54 is V, K or T; position 55 is T, position 58 is E; position 59 is T; position 60 is K; and/or position 61 is E. In some embodiments, if the CDR2 comprises a sequence in which position 56 is S, the CDR1 comprises a W at position 33. In some embodiments, the CDR2 has at least 60% identity, or at least 70% identity, to the sequence RIKSVTDGETTDYAAPVKG (SEQ ID NO:9); or at least 60% identity, or at least 70% identity, to the sequence RIKSVTEGETTDYAAPVKG (SEQ ID NO:17). In some embodiments, the CDR2 sequence has at least 80% identity, or at least 90% identity, to the sequence RIKSVTDGETTDYAAPVKG (SEQ ID NO:9) or RIKSVTEGETTDYAAPVKG (SEQ ID NO:17).

In some embodiments, an anti-tumor antibody comprises a V$_H$ CDR3 sequence T(S/T)SFCCRGG(R/S)CPS(H/R)DTS(Y/F)CGG(Q/S)(Y/D)(K/N/S)(S/R)YYYMDV (SEQ ID NO: 1747). In some embodiments, the CDR3 comprises any one of the CDR3 sequences shown in Table 2. In some embodiments, the CDR3 comprises a CDR3 sequence as shown in Table 2 in which 1, 2, 3, 4, 5, 6, 7, 8, or 9 amino acids are substituted relative to the Table 2 CDR3 sequence. For example, in some embodiments, the CDR3 comprises V at position 99, T at position 100, R at position 108, D at position 111, R at position 112, Y at position 116, and/or S at position 120. In some embodiments, a V$_H$ CDR3 comprises a sequence T(S/T)SFCCRGG(R/S)CPS(H/R)DTS(Y/F)CGG(Q/S)YKSYYYMDV (SEQ ID NO: 1751), T(S/T)SFCCRGG(R/S)CPS(H/R)DTS(Y/F)CGG(Q/S) DSRYYYMDV (SEQ ID NO: 1752), T(S/T)SFCCRGG(R/S)CPS(H/R)DTS(Y/F)CGG(Q/S)YNRYYYMDV (SEQ ID NO: 1753), T(S/T)SFCCRGG(R/S)CPS(H/R)DTS(Y/F)CGG(Q/S)YNSYYYMDV (SEQ ID NO: 1754), or T(S/T)SFCCRGG(R/S)CPS(H/R)DTS(Y/F)CGG(Q/S)

DKRYYYMDV (SEQ ID NO: 1755). In some embodiments, a $V_H$ CDR3 comprises a sequence

```
                                  (SEQ ID NO: 1758)
T(S/T)SFCCRGGSCPSHDTS(Y/F)CGG(Q/S)YKSYYYMDV,

                                  (SEQ ID NO: 1759)
T(S/T)SFCCRGGSCPSHDTS(Y/F)CGG(Q/S)DSRYYYMDV,

                                  (SEQ ID NO: 1760)
T(S/T)SFCCRGGSCPSHDTS(Y/F)CGG(Q/S)YNRYYYMDV,
or

                                  (SEQ ID NO: 1761)
T(S/T)SFCCRGGSCPSHDTS(Y/F)CGG(Q/S)DKRYYYMDV.
```

$V_L$ Regions

In some embodiments, an anti-tumor antibody of the present invention has one, two, or three CDRs of a $V_L$ sequence of any one of SEQ ID NOS:123-168 as shown in Table 1A. In some embodiments, the anti-tumor antibody has at least one mutation and no more than 10, 20, 30, 40 or 50 mutations in the $V_L$ amino acid sequences compared to a $V_L$ sequence of any one of SEQ ID NOS:123-168. In some embodiments, the $V_L$ amino acid sequence may comprise 1, 2, 3, 4, 5, 6, 7, 8, 9, or 10 amino acid insertions or deletions compared to a $V_L$ sequence of any one of SEQ ID NOS: 123-168. In some embodiments, the $V_L$ amino acid sequence may comprise a deletion or insertion, e.g., a 1, 2, 3, 4, 5, 6, or 7 amino acid deletion or insertion, relative to a CDR sequence of a $V_L$ region of any one of SEQ ID NOS:123-168. In some embodiments, the $V_L$ amino acid sequence may comprise a 1-amino acid or 2-amino acid deletion or insertion relative to a CDR sequence of a $V_L$ region of any one of SEQ ID NOS:123-168. In some embodiments, the $V_L$ region comprises a LCDR1 having 1 or 2 substitutions in relative to a LCDR1 sequence of any one SEQ ID NOS: 48-58 or 1741. In some embodiments, a LCDR1 has 3, 4, or 5 substitutions relative to a CDR1 sequence of any one SEQ ID NOS:48-58 or 1741. In some embodiments, the $V_L$ region comprises a CDR2 that has 1 or 2; or 1, 2, or 3; substitutions relative to the LCDR2 sequence of any one SEQ ID NOS: 59-67. In some embodiments, the $V_L$ region comprises a CDR3 that has 1, 2, or 3; or 1, 2, 3, or 4; substitutions relative to a LCDR3 sequence of any one SEQ ID NOS: 68-76. In some embodiments, an anti-tumor antibody of the present invention comprises a CDR1, CDR2, and CDR3, each having at least 70% identity to a CDR1, CDR2, and CDR3 to the corresponding CDR of a $V_L$ region of any one of SEQ ID NOS:123-168. In some embodiments, an anti-tumor antibody of the present invention comprises a CDR1, CDR2, and CDR3, each having at least 80% identity to the corresponding CDR1, CDR2, and CDR3 of a $V_L$ region of any one of SEQ ID NOS:123-168. In some embodiments, an anti-tumor antibody of the present invention comprises a CDR1, CDR2, and CDR3 of a $V_L$ region of any one of SEQ ID NOS:123-168. In some embodiments, an anti-tumor antibody of the present invention comprises a CDR1, CDR2, and CDR3 of an antibody designated as AIP-158623, AIP-155066, AIP-136538, AIP-166120, AIP-133645, AIP-187893, AIP-142079, AIP-160470, AIP-104188, AIP-157397, AIP-165430, AIP-189526, AIP-192482, AIP-122563, or AIP-171142 in Table 1A.

In some embodiments, a $V_L$ region of an anti-tumor antibody of the present invention has a solvent exposure of each CDR side chain, in terms of square Angstroms, as specified in this paragraph, which is based on a Fab crystal structure of an illustrative antibody. Classification as buried, intermediate, or exposed is based on cutoff values as follows: less than about 10 $Ang^2$, about 10-50 $Ang^2$, or greater than about 50 $Ang^2$, respectively. The positions are determined with reference to any one of the $V_L$ region sequences of SEQ ID NOS:123-168 provided in Table 1A. Thus, in some embodiments, an anti-tumor antibody $V_L$ region of the invention comprises a CDR1 in which position 23 is exposed; position 24 is intermediate; positions 25 and 26 are exposed; positions 27 and 28 are intermediate; positions 29, 30, and 31 are exposed; positions 32, 33, and 34 are intermediate; and position 35 is exposed. In some embodiments, an anti-tumor antibody $V_L$ of the invention comprises a CDR2 in which positions 51, 52, 53, 54, 55, 56, and 57 are exposed. In some embodiments, an anti-tumor antibody $V_L$ of the invention comprises a CDR3 in which position 90 is exposed; position 91 is buried, position 92 is exposed; position 93 is buried, positions 94, 95, 96, and 97 are exposed; position 99 is intermediate; and position 100 is exposed. In some embodiments, a residue that is classified as "buried" comprises a substitution, relative to a CDR of a $V_L$ region of any one of SEQ ID NOS:123-168, that is a conservative substitution that maintains charge and approximate size to maintain antibody conformation. In some embodiments a residue classified as "exposed" is substituted, e.g., with a conservative substitution, or with a residue that provides improved binding to cancer cells compared to a parent antibody of Table 1A.

In some embodiments, an anti-tumor antibody of the invention comprises a light chain CDR1 sequence SGSSSNIGSSSVS (SEQ ID NO:48). In some embodiments, 1, 2, 3, 4, or 5 amino acids are substituted relative to the sequence SGSSSNIGSSSVS (SEQ ID NO:48). For example, in some embodiments, position 28 is Y or H. In some embodiments, position 30 is E. In some embodiments, position 32 is N. In some embodiments, position 33 is Y or F. In some embodiments, position 35 is D or E. In some embodiments, the CDR1 has at least 60% identity, at least 70% identity, at least 80% identity, or at least 90% identity to the sequence SGSSSNIGSSSVS (SEQ ID NO:48).

In some embodiments, an anti-tumor antibody of the invention comprises a light chain CDR2 sequence (K/R)(N/D)(N/D)QRPS (SEQ ID NO: 1771). In some embodiments, the CDR2 comprises a CDR2 sequence as shown in Table 1B. In some embodiments, the CDR2 comprises a CDR2 sequence KNNQRPS (SEQ ID NO:59). In some embodiments, 1, 2, or 3 amino acid are substituted relative to the sequence KNNQRPS (SEQ ID NO:59). For example, in some embodiments, position 51 is R, position 52 is D, and/or position 53 is D. In some embodiments, the CDR2 sequence has at least 60% or at least 70% identity to the sequence KNNQRPS (SEQ ID NO:59).

In some embodiments, an anti-tumor antibody of the invention comprises a $V_L$ CDR3 sequence STWD(D/E)SLSV(R/W)V (SEQ ID NO: 1772). In some embodiments, the CDR3 sequence comprises STWD(D/E)SLSVRV (SEQ ID NO: 1762). In some embodiments, the CDR3 comprises a CDR3 sequence as shown in Table 1. In some embodiments, the CDR3 sequence comprises STWDDSLSVRV (SEQ ID NO:68) or STWDESLSVRV (SEQ ID NO:73). In some embodiments, 1, 2, or 3 amino acids are substituted relative to the sequence STWDDSLSVRV (SEQ ID NO:68) or STWDESLSVRV (SEQ ID NO:73). For example, in some embodiments position 90 is A, position 91 is I, and/or position 97 is G.

In some embodiments, the FR1 region of a $V_L$ region of an anti-tumor antibody of the invention has at least 80% or at least 90% identity to the FR1 sequence from position 1 to 22 of a $V_L$ region sequence of any one of SEQ ID NOS: 123-168. In some embodiments, the FR1 region has at least 95% identity to the FR1 sequence from position 1 to 22 of a $V_L$ region sequence of any one of SEQ ID NOS:123-168. In some embodiments, the FR1 comprises the amino acid sequence from positions 1 to 22 of a $V_L$ region sequence of any one of SEQ ID NOS:123-168.

In some embodiments, the FR2 region of a $V_L$ region of an anti-tumor antibody of the invention has at least 80% or at least 90% identity to the FR2 sequence from position 36 to 50 of a $V_L$ region sequence of any one of SEQ ID NOS:123-168. In some embodiments, the FR2 region has at least 95% identity to the FR2 sequence from position 36 to 50 of a $V_L$ region sequence of any one of SEQ ID NOS: 123-168. In some embodiments, the FR2 comprises the amino acid sequence from positions 36 to 50 of a $V_L$ region sequence of any one of SEQ ID NOS:123-168.

In some embodiments, the FR3 region of a $V_L$ region of an anti-tumor antibody of the invention has at least 80% or at least 90% identity to the FR3 sequence from position 58 to 89 of a $V_L$ region sequence of any one of SEQ ID NOS:123-168. In some embodiments, the FR3 region has at least 90% identity, or at least 95% identity to the FR3 sequence from position 58 to 89 of a $V_L$ region sequence of any one of SEQ ID NOS:123-168. In some embodiments, the FR3 comprises the amino acid sequence from position 58 to 89 of a $V_L$ region sequence of any one of SEQ ID NOS:123-168.

In some embodiments, the FR4 region a $V_H$ region of comprises the amino acid sequence from position 101 to 110 of a $V_L$ region sequence of any one of SEQ ID NOS:123-168. In some embodiments, the FR4 region comprises a substitution at one or two of the positions 101 to 110 relative to the corresponding sequence of a $V_L$ region sequence of a $V_L$ region sequence of any one of SEQ ID NOS:123-168.

In some embodiments, an anti-tumor antibody of the present invention comprises a $V_L$ region CDR1, CDR2, and/or a CDR3 as described in the preceding paragraphs is this section. In some embodiments one or two of the $V_L$ CDR sequences comprise a CDR sequence as shown in of a $V_L$ region sequence of any one of SEQ ID NOS:123-168. In some embodiments, an anti-tumor antibody of the present invention comprises a $V_L$ region CDR1, CDR2 and/or a CDR3 as described in the preceding paragraphs in this section and has at least 70% identity, at least 75% identity, at least 80% identity, or at least 85% identity, at least 90% identity, or at least 95% identity to any one of the $V_L$ sequences of SEQ ID NOS:123-168. In some embodiments, the anti-tumor antibody comprises a CDR1, CDR2, and CDR3 of a $V_L$ region sequence of any one of SEQ ID NOS:123-168 and has at least 70% identity, at least 75% identity, at least 80% identity, or at least 85% identity, at least 90% identity, or at least 95% identity to the corresponding $V_L$ region sequence as shown in Table 1A. In some embodiments, an anti-tumor antibody comprises a CDR1, CDR2, and CDR3 of an antibody designated as AIP-158623, AIP-155066, AIP-136538, AIP-166120, AIP-133645, AIP-187893, AIP-142079, AIP-160470, AIP-104188, AIP-157397, AIP-165430, AIP-189526, AIP-192482, AIP-122563, or AIP-171142 in Table 1 and comprises at least 80%, or at least 90%, identity to the corresponding $V_L$ sequence shown in Table 1A.

Illustrative Antibodies

In some embodiments, the provided herein is an anti-tumor antibody that binds to tumor tissue through a binding interaction with an extracellular RNA-protein complex, wherein the antibody comprises heavy and light chain CDRs of an antibody of Table 1 that has an AIP designation AIP-101235, AIP-127782, AIP-189473, AIP-192571, AIP-125258, AIP-150199, AIP-115388, AIP-143369, AIP-157045, AIP-175775, AIP-154181, AIP-125984, AIP-160829, AIP-184744, AIP-128136, AIP-181273, AIP-153125, AIP-160470, AIP-192482, AIP-171142, AIP-157397, AIP-165430, AIP-189526, AIP-122563, AIP-158623, AIP-155066, AIP-136538, AIP-166120, AIP-133645, AIP-187893, AIP-142079, AIP-104188, AIP-106042, AIP-100196, AIP-180675, AIP-170105, AIP-126080, AIP-161571, AIP-181246, AIP-192216, AIP-168605, AIP-172872, AIP-190051, AIP-167533, AIP-112580, AIP-136060, or a variant thereof as described herein. In some embodiments, the antibody comprises an HCDR1 of any one of SEQ ID NOS:1-8, or a variant thereof in which 1, 2, 3, 4, or 5 amino acids are substituted relative to the sequence, an HCDR2 of any one of SEQ ID NOS:9-19, or a variant thereof in which 1, 2, 3, 4, or 5 amino acids are substituted relative to the sequence; an HCDR3 of any one of SEQ ID NOS:20-47 or a variant thereof in which 1, 2, 3, 4, 5, 6, 7, 8, 9, or 10 amino acids are substituted relative to the sequence; an LCDR1 of any one of SEQ ID NOS: 48-58' or 1741, or a variant thereof in which 1, 2, 3, 4, or 5 amino acids are substituted relative to the sequence; an LCDR2 of any one of SEQ ID NOS:59-67, or a variant thereof in which 1, 2, or 3 amino acids are substituted relative to the sequence; and an LCDR3 of any one of SEQ ID NOS:68-76, or a variant thereof in which 1, 2, 3, 4, or 5 amino acids are substituted relative to the sequence. In some embodiments, at least 1 or 2 of the substitutions are conservative substitutions. In some embodiments, at least 50% or at least 60%, at least 70%, at least 80%, or at least 90% of of the substitutions, relative to the reference CDR sequence are conservative substitutions. In some embodiments, when an antibody comprises the six CDRs of the antibody designated as AIP-192482, the sequence of the $V_H$ region is not the sequence of SEQ ID NO:95 or the sequence of the $V_L$ region is not the sequence of SEQ ID NO:141.

In some embodiments, the antibody comprises an HCDR1 of any one of SEQ ID NOS:1-8, or a variant thereof in which 1 or 2 amino acids are substituted relative to the sequence, an HCDR2 of any one of SEQ ID NOS:9-19, or a variant thereof in which 1 or 2 amino acids are substituted relative to the sequence; an HCDR3 of any one of SEQ ID NOS: 20-47 or a variant thereof in which 1, 2, or 3; or in which 1 or 2; amino acids are substituted relative to the sequence; an LCDR1 of any one of SEQ ID NOS:48-58 or 1741, or a variant thereof in which 1 or 2 amino acids are substituted relative to the sequence; an LCDR2 of any one of SEQ ID NOS:59-67', or a variant thereof in which 1 or 2 amino acids are substituted relative to the sequence; and an LCDR3 of any one of SEQ ID NOS:68-76, or a variant thereof in which 1 or 2 amino acids are substituted relative to the sequence. In some embodiments, at least 1 or 2 of the substitutions are conservative substitutions.

In some embodiments, provided herein is an antibody that binds to tumor tissue through a binding interaction with an extracellular RNA-protein complex, where the antibody comprises: (a) a heavy chain variable region comprising: (i) an HCDR1 having the sequence of GF(T/V)(F/Y)(S/A)$X_6$AWM(S/T) (SEQ ID NO:1728), wherein $X_6$ is K, A, or M; (ii) an HCDR2 having the sequence of RIK(S/A)$X_5X_6$(D/E)(G/A)$X_9X_{10}$T(D/E)YAA(P/S)VKG (SEQ ID NO:1729), wherein $X_5$ is V, N, A, or T; $X_6$ is T, Q, S, D, or H; $X_9$ is E, H, K, or G; and $X_{10}$ is T, Q, or I; and (iii) an HCDR3 having the sequence of (I/T)(S/T)SFCC(H/R)(G/S)$X_9X_{10}$CPS$X_{14}$(D/E)TS(F/Y)C$X_{20}$(G/N)$X_{22}X_{23}X_{24}X_{25}$(F/

Y)Y(F/Y) (M/V)(D/N)$X_{31}$ (SEQ ID NO:1730), wherein $X_9$ is A, G, K, or N; $X_{10}$ is N, Q, R, or S; $X_{14}$ is H, R, or S; $X_{20}$ is A, G, or N; $X_{22}$ is Q, S, or Y; $X_{23}$ is D, F, N, or Y; $X_{24}$ is A, K, N, P, or S; $X_{25}$ is D, Q, R, or S; $X_{31}$ is I, P, or V; and (b) a light chain variable region comprising: (i) a CDR L1 having the sequence of SG(S/A)$X_4$(S/T)(D/N) IGSS$X_{11}$V$X_{13}$ (SEQ ID NO:1731), wherein $X_4$ is S, P, or K; $X_{11}$ is S, Y, or T; and $X_{13}$ is S, Y, or T; (ii) a CDR L2 having the sequence of (K/M)(D/N)$X_3X_4$R(A/P)$X_7$ (SEQ ID NO:1732), wherein $X_3$ is S, N or T; $X_4$ is L, Q, or A; and $X_7$ is Q, S, Y, or L; and (iii) a CDR L3 having the sequence of (A/S)(S/T)W(D/N)$X_5X_6$(L/N)$X_8$(I/V)R(I/V) (SEQ ID NO:1733), wherein $X_5$ is E, D or N; $X_6$ is S, A, or Q; and $X_8$ is N, S or T.

In some embodiments, in the HCDR1 sequence of the antibody, position 3 of the HCDR1 is T; position 4 is F; position 5 is S; position 6 is K; and/or position 10 is S. In particular embodiments, the HCDR1 of the antibody has the sequence of GFTFSKAWMS (SEQ ID NO:1). In other embodiments, the HCDR1 of the antibody has a sequence of any one of GFTFSAAWMS (SEQ ID NO:4), GFVFSKAWMS (SEQ ID NO:7), GFTFAKAWMS (SEQ ID NO:6), GFTYSKAWMS (SEQ ID NO:5), GFTFSMAWMS (SEQ ID NO:3), GFTYSAAWMS (SEQ ID NO:2), and GFTFSKAWMT (SEQ ID NO:8).

In some embodiments, in the HCDR2 sequence of the antibody, position 4 of the HCDR2 is S; position 5 is V; position 6 is T; position 7 is D; position 8 is G; position 9 is E; position 10 is T; position 12 is D; and/or position 16 is P. In particular embodiments, the HCDR2 of the antibody has the sequence of RIKSVTDGETTDYAAPVKG (SEQ ID NO:9). In other embodiments, the HCDR2 of the antibody has a sequence of any one of

```
                              (SEQ ID NO: 18)
RIKSVTDGEQTDYAAPVKG,

                              (SEQ ID NO: 19)
RIKAADDGKQTDYAAPVKG,

                             (SEQ ID NO: 504)
RIKSVTDGETTEYAASVKG,

                              (SEQ ID NO: 10)
RIKAVHDGETTDYAAPVKG,

                              (SEQ ID NO: 11)
RIKSNTDAETTDYAAPVKG,

                              (SEQ ID NO: 12)
RIKSVQDGETTDYAAPVKG,

                              (SEQ ID NO: 13)
RIKSVTDGHTTDYAAPVKG.

                              (SEQ ID NO: 14)
RIKSVTDGGITDYAAPVKG,

                              (SEQ ID NO: 15)
RIKSTSDGETTDYAAPVKG,

                              (SEQ ID NO: 16)
RIKSTSDGGITDYAAPVKG,
or and

                              (SEQ ID NO: 17)
RIKSVTEGETTDYAAPVKG.
```

In some embodiments, in the HCDR3 sequence of the antibody, position 1 of the HCDR3 is T; position 2 is S; position 7 is R; position 8 is G; position 9 is G; position 10 is S; position 14 is H; position 15 is D; position 18 is Y; position 20 is G; and/or position 21 is G. In particular embodiments, the HCDR3 of the antibody has the sequence of any one of TSSFCCRGGSCPSHDTSYCGGYYKSYYYMDV (SEQ ID NO:33), TSSFCCRGGSCPSHDTSYCGGQYKSYYYMDV (SEQ ID NO:21), and TSSFCCRGGSCPSHDTSYCGGQYKSFYYMDV (SEQ ID NO:28). In other embodiments, the HCDR3 of the antibody has the sequence of any one of

```
                                          (SEQ ID NO: 32)
TSSFCCRGGSCPSSDTSYCGGQYKSYYFMDV,

                                          (SEQ ID NO: 30)
ISSFCCRGGSCPSRDTSYCGGQYKSYYFMDV,

                                          (SEQ ID NO: 29)
ISSFCCRGNSCPSSDTSYCNGQYKSYYFMDV,

                                          (SEQ ID NO: 27)
ISSFCCRGNSCPSSDTSYCNGQYKSYYYMDV,

                                          (SEQ ID NO: 26)
ISSFCCHSNNCPSSDTSYCNGYYKQYYFMDV,

                                          (SEQ ID NO: 25)
ISSFCCRGKQCPSSDTSYCGGQFKSYYFMDV,

                                          (SEQ ID NO: 24)
ISSFCCRGKQCPSSDTSYCNGYYADYYFMDV,

                                          (SEQ ID NO: 23)
TSSFCCRGNQCPSSDTSYCGGQYPSYYYMDP,

                                          (SEQ ID NO: 22)
TTSFCCRGASCPSSDTSYCAGSYKSYYFVNI,

                                          (SEQ ID NO: 20)
TSSFCCRSGSCPSSDTSYCNGQYKSYYYMDV,

                                          (SEQ ID NO: 42)
TSSFCCRGGSCPSHDTSYCGGQDSRYYYMDV,

                                          (SEQ ID NO: 41)
TSSFCCRGGSCPSHDTSFCGGSYKSYYYMDV,

                                          (SEQ ID NO: 37)
TSSFCCRGGSCPSHDTSFCGGQYKSYYYMDV,

                                          (SEQ ID NO: 40)
TSSFCCRGGSCPSHDTSFCGGQDSRYYYMDV,

                                          (SEQ ID NO: 39)
TTSFCCRGGSCPSHDTSFCGGQYKSYYYMDV,

                                          (SEQ ID NO: 34)
TSSFCCRGGSCPSHDTSFCGGQDKRYYYMDV,

                                          (SEQ ID NO: 38)
TTSFCCRGGRCPSRDTSFCGGQYNSYYYMDV,

                                          (SEQ ID NO: 36)
TSSFCCRGGSCPSHDTSFCGGQYNRYYYMDV,
and

                                          (SEQ ID NO: 35)
TTSFCCRGGSCPSHDTSFCGGQDKRYYYMDV.
```

In some embodiments, in the LCDR1 sequence of the antibody, position 3 is S; position 4 is S; position 5 is S; position 6 is N; position 11 is S; and/or position 13 is S. In particular embodiments, the LCDR1 of the antibody has the sequence of SGSSSNIGSSSVS (SEQ ID NO:48). In other embodiments, the LCDR1 has the sequence of any one of

```
SGSKSNIGSSYVS,     (SEQ ID NO: 50)

SGSSSNIGSSSVY,     (SEQ ID NO: 56)

SGSKSNIGSSSVY,     (SEQ ID NO: 55)

SGSSTNIGSSSVS,     (SEQ ID NO: 54)

SGASSNIGSSSVS,     (SEQ ID NO: 52)

SGSSTNIGSSTVS,     (SEQ ID NO: 53)

SGSKSNIGSSSVS,     (SEQ ID NO: 51)
and

SGSSTNIGSSSVT.     (SEQ ID NO: 49)
```

In some embodiments, in the LCDR2 sequence of the antibody, position 1 is K; position 2 is N; position 3 is N; position 4 is Q; position 6 is P; and/or position 7 is S. In particular embodiments, the LCDR2 has the sequence of KNNQRPS (SEQ ID NO:59). In other embodiments, the LCDR2 has the sequence of any one of KNNQRPY (SEQ ID NO:66), KDNQRPS (SEQ ID NO:62), KNTQRPS (SEQ ID NO:65), KNNARPY (SEQ ID NO:64), KNTQRAS (SEQ ID NO:63), MNNQRPY (SEQ ID NO:61), and KDNQRPL (SEQ ID NO:60).

In some embodiments, in the LCDR3 sequence of the antibody, position 1 of the LCDR3 is S; position 2 is T; position 4 is D; position 5 is D; position 6 is S; position 7 is L; position 8 is S; position 9 is V; and/or position 11 is V. In particular embodiments, the LCDR3 of the antibody has the sequence of STWDDSLSVRV (SEQ ID NO:68). In other embodiments, the LCDR3 has the sequence of any one of STWDDALSVRV (SEQ ID NO:72), SSWDDSNSVRI (SEQ ID NO:71), ATWDDQLSVRV (SEQ ID NO:69), ATWDDSLTVRI (SEQ ID NO:76), ATWDNSLSIRV (SEQ ID NO:70), and STWDESLSVRV (SEQ ID NO:73).

In the antibodies described herein, the HCDR1 can have a sequence of any one of GFTFSKAWMS (SEQ ID NO:1), GFTFSAAWMS (SEQ ID NO:4), and GFTFSKAWMT (SEQ ID NO:8); the HCDR2 can have a sequence of any one of RIKSVTDGETTDYAAPVKG (SEQ ID NO:9) and RIKSTSDGETTDYAAPVKG (SEQ ID NO:15); the HCDR3 can have a sequence of any one of TSSFCCRGGSCPSSDTSYCGGQYKSYYFMDV (SEQ ID NO:32), TSSFCCRSGSCPSSDTSYCNGQYKSYYYMDV (SEQ ID NO:20), TSSFCCRGNQCPSSDTSYCGGQYPSYYYMDP (SEQ ID NO:23), ISSFCCRGGSCPSRDTSYCGGQYKSYYFMDV (SEQ ID NO:30), ISSFCCRGNSCPSSDTSYCNGQYKSYYYMDV (SEQ ID NO:27), TSSFCCRGGSCPSHDTSYCGGQYKSYYYMDV (SEQ ID NO:21), and TSSFCCRGGSCPSHDTSFCGGQDKRYYYMDV (SEQ ID NO:34); the LCDR1 can have a sequence of any one of SGSSSNIGSSSVY (SEQ ID NO:56), SGSSSNIGSSSVS (SEQ ID NO:48), SGSSTNIGSSSVS (SEQ ID NO:54), and SGSKSNIGSSSVS (SEQ ID NO:51); the LCDR2 can have a sequence of any one of KNNQRPS (SEQ ID NO:59) and KDNQRPS (SEQ ID NO:62); the LCDR3 can have a sequence of any one of STWDDALSVRV (SEQ ID NO:72), STWDDSLSVRV (SEQ ID NO:68), SSWDDSNSVRI (SEQ ID NO:71), and ATWDNSLSIRV (SEQ ID NO:70).

In some embodiments, the heavy chain variable region of the antibodies described herein can have a sequence having at least 90% (e.g., 91%, 92%, 93%, 94%, 95%, 96%, 97%, 98%, 99%, or 100%) identity to the sequence of any one of

```
                                                  (SEQ ID NO: 92)
EVQLVESGGALVKPGGSLRLSCAASGFTFSKAWMSWVRQAPGKGLEWVGR
IKSVTDGETTDYAAPVKGRFTISRDDSKSTLYLQMNSLKTEDTAVYYCTS
SFCCRGGSCPSSDTSYCGGQYKSYYFMDVWGKGTTVTVSS,

                                                  (SEQ ID NO: 77)
EVQLVESGGALVKPGGSLRLSCAASGFTFSKAWMSWVRQAPGKGLEWVGR
IKSVTDGETTDYAAPVKGRFTISRDDSKSTLYLQMNSLKTEDTAVYYCTS
SFCCRSGSCPSSDTSYCNGQYKSYYYMDVWGKGTTVTVSS,

                                                  (SEQ ID NO: 80)
EVQLVESGGALVKPGGSLRLSCAASGFTFSKAWMSWVRQAPGKGLEWVGR
IKSVTDGETTDYAAPVKGRFTISRDDSKSTLYLQMNSLKTEDTAVYYCTS
SFCCRGNQCPSSDTSYCGGQYPSYYYMDPWGKGTTVTVSS,

                                                  (SEQ ID NO: 90)
EVQLVESGGALVKPGGSLRLSCAASGFTFSAAWMSWVRQAPGKGLEWVGR
IKSTSDGETTDYAAPVKGRFTISRDDSKSTLYLQMNSLKTEDTAVYYCIS
SFCCRGGSCPSRDTSYCGGQYKSYYFMDVWGKGTTVTVSS,

                                                  (SEQ ID NO: 86)
EVQLVESGGALVKPGGSLRLSCAASGFTFSAAWMSWVRQAPGKGLEWVGR
IKSVTDGETTDYAAPVKGRFTISRDDSKSTLYLQMNSLKTEDTAVYYCIS
SFCCRGNSCPSSDTSYCNGQYKSYYYMDVWGKGTTVTVSS,

                                                  (SEQ ID NO: 94)
EVQLVESGGALVKPGGSLRLSCAASGFTFSKAWMSWVRQAPGKGLEWVGR
IKSVTDGETTDYAAPVKGRFTISRDDSKSTLYLQMNSLKTEDTAVYYCTS
SFCCRGGSCPSHDTSYCGGQYKSYYYMDVWGKGTTVTVSS,
and

                                                  (SEQ ID NO: 95)
EVQLVESGGALVKPGGSLRLSCAASGFTFSKAWMTWVRQAPGKGLEWVGR
IKSVTDGETTDYAAPVKGRFTISRDDSKSVLYLQMSSLKTEDTAVYFCTS
SFCCRGGSCPSHDTSFCGGQDKRYYYMDVWGKGTTVTVSS.
```

In some embodiments, the light chain variable region of the antibodies described herein can have a sequence having at least 90% (e.g., 91%, 92%, 93%, 94%, 95%, 96%, 97%, 98%, 99%, or 100%) identity to the sequence of any one of

```
                                                  (SEQ ID NO: 138)
QSVLTQPPSASGTPGQRVTISCSGSSSNIGSSSVYWYQQLPGTAPKLLIY
KNNQRPSGVPDRFSGSKSGTSASLAISGLRSEDEADYYCSTWDDALSVRV
FGGGTKLTVL,

                                                  (SEQ ID NO: 140)
QSVLTQPPSASGTPGQRVTISCSGSSSNIGSSSVSWYQQLPGTAPKLLIY
KNNQRPSGVPDRFSGSKSGTSASLAISGLRSEDEADYYCSTWDDSLSVRV
FGGGTKLTVL,

                                                  (SEQ ID NO: 136)
QSVLTQPPSASGTPGQRVTISCSGSSTNIGSSSVSWYQQLPGTAPKLLIY
KDNQRPSGVPDRFSGSKSGTSASLAISGLRSEDEADYYCSSWDDSNSVRI
FGGGTKLTVL,

                                                  (SEQ ID NO: 132)
QSVLTQPPSASGTPGQRVTISCSGSKSNIGSSSVSWYQQLPGTAPKLLIY
KDNQRPSGVPDRFSGSKSGTSASLAISGLRSEDEADYYCATWDNSLSIRV
FGGGTKLTVL,
and

                                                  (SEQ ID NO: 141)
QSVLTQAPSASETPGQRVIISCSGSSSNIGSSSVSWYQQLPGTAPKLLIY
KNNQRPSGVPDRFSGSKSGTSASLAISGLRSEDEADYYCSTWDDSLSVRV
FGGGTKLTVL.
```

In certain embodiments, an antibody described herein can comprise an HCDR1 having a sequence of GFTFSKAWMS (SEQ ID NO:1); the HCDR2 having a sequence of RIKSVTDGETTDYAAPVKG (SEQ ID NO:9); an HCDR3 having a sequence of TSSFCCRGGSCPSSDTSYCGGQYKSYYFMDV (SEQ ID NO:32); an LCDR1 having a sequence of SGSSSNIGSSSVY (SEQ ID NO:56); an LCDR2 having a sequence of KNNQRPS (SEQ ID NO:59); and an LCDR3 having a sequence of STWDDALSVRV (SEQ ID NO:72). In some embodiments, the heavy chain variable region of the antibody has a sequence having at least 90% (e.g., 91%, 92%, 93%, 94%, 95%, 96%, 97%, 98%, 99%, or 100%) identity to the sequence of EVQLVESGGALVKPGGSLRLSCAASGFTFSKAWMSWVRQAPGKGLEWVGRIKSVT DGETTDYAAPVKGRFTISRDDSKSTLYLQMNSLKTEDTAVYYCTSSFCCRGGSCPSS DTSYCGGQYKSYYFMDVWGKGTTVTVSS (SEQ ID NO:92); and the light chain variable region of the antibody has a sequence having at least 90% (e.g., 91%, 92%, 93%, 94%, 95%, 96%, 97%, 98%, 99%, or 100%) identity to the sequence of

```
                                        (SEQ ID NO: 138)
QSVLTQPPSASGTPGQRVTISCSGSSSNIGSSSVYWYQQLPGTAPKLLIY
KNNQRPSGVPDRFSGSKSGTSASLAISGLRSEDEADYYCSTWDDALSVRV
FGGGTKLTVL.
```

In certain embodiments, an antibody described herein can have an HCDR1 having a sequence of GFTFSKAWMS (SEQ ID NO:1); an HCDR2 having a sequence of RIKSVTDGETTDYAAPVKG (SEQ ID NO:9); an HCDR3 having a sequence of TSSFCCRSGSCPSSDTSYCNGQYKSYYYMDV (SEQ ID NO:20); an LCDR1 having a sequence of SGSSSNIGSSSVS (SEQ ID NO:48); an LCDR2 having a sequence of KNNQRPS (SEQ ID NO:59); and an LCDR3 having a sequence of STWDDSLSVRV (SEQ ID NO:68). In some embodiments, the heavy chain variable region of the antibody has a sequence having at least 90% (e.g., 91%, 92%, 93%, 94%, 95%, 96%, 97%, 98%, 99%, or 100%) identity to the sequence of EVQLVESGGALVKPGGSLRLSCAASGFTFSKAWMSWVRQAPGKGLEWVGRIKSVT DGETTDYAAPVKGRFTISRDDSKSTLYLQMNSLKTEDTAVYYCTSSFCCRSGSCPSS DTSYCNGQYKSYYYMDVWGKGTTVTVSS (SEQ ID NO:77); and the light chain variable region of the antibody has a sequence having at least 90% (e.g., 91%, 92%, 93%, 94%, 95%, 96%, 97%, 98%, 99%, or 100%) identity to the sequence of

```
                                        (SEQ ID NO: 140)
QSVLTQPPSASGTPGQRVTISCSGSSSNIGSSSVSWYQQLPGTAPKLLIY
KNNQRPSGVPDRFSGSKSGTSASLAISGLRSEDEADYYCSTWDDSLSVRV
FGGGTKLTVL.
```

In certain embodiments, an antibody described herein can have an HCDR1 having a sequence of GFTFSKAWMS (SEQ ID NO:1); an HCDR2 having a sequence of RIKSVTDGETTDYAAPVKG (SEQ ID NO:9); an HCDR3 having a sequence of TSSFCCRGNQCPSSDTSYCGGQYPSYYYMDP (SEQ ID NO:23); an LCDR1 having a sequence of SGSSSNIGSSSVS (SEQ ID NO:48); an LCDR2 having a sequence of KNNQRPS (SEQ ID NO:59); and an LCDR3 having a sequence of STWDDSLSVRV (SEQ ID NO:68). In some embodiments, the heavy chain variable region of the antibody has a sequence having at least 90% (e.g., 91%, 92%, 93%, 94%, 95%, 96%, 97%, 98%, 99%, or 100%) identity to the sequence of EVQLVESGGALVKPGGSLRLSCAASGFTFSKAWMSWVRQAPGKGLEWVGRIKSVT DGETTDYAAPVKGRFTISRDDSKSTLYLQMNSLKTEDTAVYYCTSSFCCRGNQCPSS DTSYCGGQYPSYYYMDPWGKGTTVTVSS (SEQ ID NO:80); and the light chain variable region of the antibody has a sequence having at least 90% (e.g., 91%, 92%, 93%, 94%, 95%, 96%, 97%, 98%, 99%, or 100%) identity to the sequence of

```
                                        (SEQ ID NO: 140)
QSVLTQPPSASGTPGQRVTISCSGSSSNIGSSSVSWYQQLPGTAPKLLIY
KNNQRPSGVPDRFSGSKSGTSASLAISGLRSEDEADYYCSTWDDSLSVRV
FGGGTKLTVL.
```

In certain embodiments, an antibody described herein can have an HCDR1 having a sequence of GFTFSAAWMS (SEQ ID NO:4); an HCDR2 having a sequence of RIKSTSDGETTDYAAPVKG (SEQ ID NO:15); an HCDR3 having a sequence of ISSFCCRGGSCPSRDTSYCGGQYKSYYFMDV (SEQ ID NO:30); an LCDR1 having a sequence of SGSSTNIGSSSVS (SEQ ID NO:54); an LCDR2 having a sequence of KDNQRPS (SEQ ID NO:62); and an LCDR3 having a sequence of SSWDDSNSVRI (SEQ ID NO:71). In some embodiments, the heavy chain variable region of the antibody has a sequence having at least 90% (e.g., 91%, 92%, 93%, 94%, 95%, 96%, 97%, 98%, 99%, or 100%) identity to the sequence of EVQLVESGGALVKPGGSLRLSCAASGFTFSAAWMSWVRQAPGKGLEWVGRIKSTSD GETTDYAAPVKGRFTISRDDSKSTLYLQMNSLKTEDTAVYYCISSFCCRGGSCPSRDT SYCGGQYKSYYFMDVWGKGTTVTVSS (SEQ ID NO:90); and the light chain variable region of the antibody has a sequence having at least 90% (e.g., 91%, 92%, 93%, 94%, 95%, 96%, 97%, 98%, 99%, or 100%) identity to the sequence of

```
                                        (SEQ ID NO: 136)
QSVLTQPPSASGTPGQRVTISCSGSSTNIGSSSVSWYQQLPGTAPKLLIY
KDNQRPSGVPDRFSGSKSGTSASLAISGLRSEDEADYYCSSWDDSNSVRI
FGGGTKLTVL.
```

In certain embodiments, an antibody described herein can have an HCDR1 having a sequence of GFTFSAAWMS (SEQ ID NO:4); an HCDR2 having a sequence of RIKSVTDGETTDYAAPVKG (SEQ ID NO:9); an HCDR3 having a sequence of ISSFCCRGNSCPSSDTSYCNGQYKSYYYMDV (SEQ ID NO:27); an LCDR1 having a sequence of SGSKSNIGSSSVS (SEQ ID NO:51); an LCDR2 having a sequence of KDNQRPS (SEQ ID NO:62); an LCDR3 having a sequence of ATWDNSLSIRV (SEQ ID NO:70). In some embodiments, the heavy chain variable region of the antibody has a sequence having at least 90% (e.g., 91%, 92%, 93%, 94%, 95%, 96%, 97%, 98%, 99%, or 100%) identity to the sequence of EVQLVESGGALVKPGGSLRLSCAASGFTFSAAWMSWVRQAPGKGLEWVGRIKSVT DGETTDYAAPVKGRFTISRDDSKSTLYLQMNSLKTEDTAVYYCISSFCCRGNSCPSSD TSYCNGQYKSYYYMDVWGKGTTVTVSS (SEQ ID NO:86); and the light chain variable region of the antibody has a sequence having at least 90% (e.g., 91%, 92%, 93%, 94%, 95%, 96%, 97%, 98%, 99%, or 100%) identity to the sequence of (SEQ ID NO: 132)
QSVLTQPPSASGTPGQRVTISCSGSKSNIGSSSVSWYQQLPGTAPKLLIY
KDNQRPSGVPDRFSGSKSGTSASLAISGLRSEDEADYYCATWDNSLSIRV
FGGGTKLTVL.

In certain embodiments, an antibody described herein can have an HCDR1 having a sequence of GFTFSKAWMS (SEQ ID NO:1); an HCDR2 having a sequence of RIKSVTDGETTDYAAPVKG (SEQ ID NO:9); an HCDR3 having a sequence of TSSFCCRGGSCP-SHDTSYCGGQYKSYYYMDV (SEQ ID NO:21); an LCDR1 having a sequence of SGSSSNIGSSSVS (SEQ ID NO:48); an LCDR2 having a sequence of KNNQRPS (SEQ ID NO:59); and an LCDR3 having a sequence of STWDD-SLSVRV (SEQ ID NO:68). In some embodiments, the heavy chain variable region of the antibody has a sequence having at least 90% (e.g., 91%, 92%, 93%, 94%, 95%, 96%, 97%, 98%, 99%, or 100%) identity to the sequence of EVQLVESGGALVKPGGSLRLS-CAASGFTFSKAWMSWVRQAPGKGLEWVGRIKSVT DGETTDYAAPVKGRFTISRDDSKSTLYLQMNSLKT-EDTAVYYCTSSFCCRGGSCPSH DTSYCGGQYKSYYYMDVWGKGTTVTVSS (SEQ ID NO:94); and the light chain variable region of the antibody has a sequence having at least 90% (e.g., 91%, 92%, 93%, 94%, 95%, 96%, 97%, 98%, 99%, or 100%) identity to the sequence of (SEQ ID NO: 140)
QSVLTQPPSASGTPGQRVTISCSGSSSNIGSSSVSWYQQLPGTAPKLLIY
KNNQRPSGVPDRFSGSKSGTSASLAISGLRSEDEADYYCSTWDDSLSVRV
FGGGTKLTVL.

In certain embodiments, an antibody described herein can have an HCDR1 having a sequence of GFTFSKAWMT (SEQ ID NO:8); an HCDR2 having a sequence of RIKSVTDGETTDYAAPVKG (SEQ ID NO:9); an HCDR3 having a sequence of TSSFCCRGGSCP-SHDTSFCGGQDKRYYYMDV (SEQ ID NO:34); an LCDR1 having a sequence of SGSSSNIGSSSVS (SEQ ID NO:48); an LCDR2 having a sequence of KNNQRPS (SEQ ID NO:59); and an LCDR3 having a sequence of STWDD-SLSVRV (SEQ ID NO:68). In some embodiments, the heavy chain variable region of the antibody has a sequence having at least 90% (e.g., 91%, 92%, 93%, 94%, 95%, 96%, 97%, 98%, 99%, or 100%) identity to the sequence of EVQLVESGGALVKPGGSLRLS-CAASGFTFSKAWMTWVRQAPGKGLEWVGRIKSVT DGETTDYAAPVKGRFTISRDDSKSVLYLQMS SLKT-EDTAVYFCTSSFCCRGGSCPSH DTSFCGGQDKRYYYMDVWGKGTTVTVSS (SEQ ID NO:95); and the light chain variable region of the antibody has a sequence having at least 90% (e.g., 91%, 92%, 93%, 94%, 95%, 96%, 97%, 98%, 99%, or 100%) identity to the sequence of QSVLTQAPSASETPGQRVH-SCSGSSSNIGSSSVSWYQQLPGTAPKLLIYKNNQRP-SGV PDRFSGSKSGTSASLAISGLRSEDEADYYC-STWDDSLSVRVFGGGTKLTVL (SEQ ID NO:141). In some embodiments, an antibody having an HCDR1 sequence of GFTFSKAWMT (SEQ ID NO:8); an HCDR2 sequence of RIKSVTDGETTDYAAPVKG (SEQ ID NO:9); an HCDR3 sequence of TS SFCCRGGSCP-SHDTSFCGGQDKRYYYMDV (SEQ ID NO:34); an LCDR1 sequence of SGSSSNIGSSSVS (SEQ ID NO:48); an LCDR2 sequence of KNNQRPS (SEQ ID NO:59); and an LCDR3 having a sequence of STWDDSLSVRV (SEQ ID NO:68), has a $V_H$ sequence or $V_L$ sequence that differs by at least one amino acid from the heavy chain variable region sequence SEQ ID NO:95 or the light chain variable region sequence SEQ ID NO:141.

In one aspect, provided herein is an antibody comprising a $V_H$ and $V_L$ region as described herein, e.g., an antibody having a $V_H$ and $V_L$ region as set forth in Table 1, or a variant thereof, that further comprises a human IgG1 constant region and/or a human lambda constant region. In some embodiments, the antibody comprises a heavy chain sequence ASTKGPSVFPLAPSSKSTSGGTAAL-GCLVKDYFPEPVTVSWNSGALTSGVHTFPAVL QSSG-LYSLSSVVTVPSSSLGTQTYICNVNHKPSNTKV-DKRVEPKSCDKTHTCPPCPAP ELLGGPSVFLFPPKPKDTLMISRTPE-VTCVVVDVSHEDPEVKFNWYVDGVEVHNAK TKPREEQYN-STYRVVSVLTVLHQDWLNGKEYKCKVSNKALPA-PIEKTISKAKGQPR EPQVYTLPPSREEMTKNQVSLT-CLVKGFYPSDIAVEWESNGQPENNYKTTPPVLDSD GSFFLYSKLTVDKSRWQQGNVFSCSVMHEALHN-HYTQKSLSLSPG (SEQ ID NO:1721), or a variant thereof having at least 90% identity to SEQ ID NO:1721. In some embodiments, the antibody comprises the amino acid sequence of SEQ ID NO:1721 in which 1, 2, 3, 4, 5, 6, 7, 8, 9, or 10 amino acids are mutated, e.g., to modulate FcR binding, effector function, glycosylation, and/or stability. In some embodiments, the antibody comprises a light chain sequence GQPKAAPSVTLFPPS-SEELQANKATLVCLVSDFYP-GAVTVAWKADGSPVKVGVETT KPSKQSNNKYAAS-SYLSLTPEQWKSHRSYSCRVTHEGSTVEKTVAPAECS (SEQ ID NO:1722). In some embodiments, the antibody comprises a sequence having at least 90% identity, or at least 95% identity, or greater, to SEQ ID NO:1722.

In some embodiments, the $V_H$ region of an antibody of the present invention has a CDR1 comprising GFTFSKAWMS (SEQ ID NO:1), a CDR2 comprising RIKSVTDGETTDYAAPVKG (SEQ ID NO:9), and a CDR3 comprising TSSFCCRGGSCP-SHDTSYCGGQYKSYYYMDV (SEQ ID NO:21); and a $V_L$ region having a CDR1 comprising SGSSSNIGSSSVS (SEQ ID NO:48), a CDR2 comprising KNNQRPS (SEQ ID NO:59), and a CDR3 comprising STWDDSLSVRV (SEQ ID NO:68). In some embodiments, such an antibody comprises a human IgG1 and/or a human lambda constant region. In some embodiments, the $V_H$ region comprises the amino acid sequence of SEQ ID NO:94 and the $VL$ region comprises the amino acid sequence of SEQ ID NO:140. In some embodiments, the antibody comprises a heavy chain sequence ASTKGPSVFPLAPSSKSTSGGTAAL-GCLVKDYFPEPVTVSWNSGALTSGVHTFPAVL QSSG-LYSLSSVVTVPSSSLGTQTYICNVNHKPSNTKVDK-RVEPKSCDKTHTCPPCPAP ELLGGPSVFLFPPKPKDTLMISRTPE-VTCVVVDVSHEDPEVKFNWYVDGVEVHNAK TKPREEQYN-STYRVVSVLTVLHQDWLNGKEYKCKVSNKALPA-PIEKTISKAKGQPR EPQVYTLPPSREEMTKNQVSLT-CLVKGFYPSDIAVEWESNGQPENNYKTTPPVLDSD GSFFLYSKLTVDKSRWQQGNVFSCSVMHEALHN-HYTQKSLSLSPG (SEQ ID NO:1721), or a variant thereof having at least 90% identity to SEQ ID NO:1721. In some embodiments, the antibody comprises the amino acid sequence of SEQ ID NO:1721 in which 1, 2, 3, 4, 5, 6, 7, 8, 9, or 10 amino acids are mutated, e.g., to modulate FcR binding, effector function, glycosylation, and/or stability. In some embodiments, the antibody comprises a light chain sequence GQPKAAPSVTLFPPS-SEELQANKATLVCLVSDFYP-GAVTVAWKADGSPVKVGVETT KPSKQSNNKYAAS-SYLSLTPEQWKSHRSYSCRVTHEGSTVEKTVAPAECS (SEQ ID NO:1722). In some embodiments, the antibody comprises a sequence having at least 90% identity, or at least 95% identity, or greater, to SEQ ID NO:1722. In some embodiments, an antibody of the present invention comprises a heavy chain sequence EVQLVESG-GALVKPGGSLRLSCAASGFTFSKAWMSWVRQAPGK-GLEWVGRIKSVT DGETTDYAAPVKGRFTISRDDSKSTLYLQMNSLKT-EDTAVYYCTSSFCCRGGSCPSH DTSYCGGQYKSYYYMDVWGKGTTVTVSSAS-TKGPSVFPLAPSSKSTSGGTAALGCL VKDYF-PEPVTVSWNSGALTSGVHTFPAVLQSSGLYS-LSSVVTVPSSSLGTQTYICNVN HKPSNTKVDKRVEPKSCDKTHTCPPCPA-PELLGGPSVFLFPPKPKDTLMISRTPEVTC VVVDVSHEDPEVKFNWYVDGVEVHNAKTKPRE-EQYNSTYRVVSVLTVLHQDWLN GKEYKCKVSNKA-LPAPIEKTISKAKGQPREPQVYTLPPSREEMT-KNQVSLTCLVKGF YPSDIAVEWESNGQPENNYKTTPPVLDSDGSFFLY-SKLTVDKSRWQQGNVFSCSVM HEALHN-HYTQKSLSLSPG (SEQ ID NO:1723) and a light chain sequence QSVLTQPP-SASGTPGQRVTISCSGSSSNIGSSSVSWYQQLPGT-APKLLIYKNNQRPSGV PDRFSGSKSGTSASLAIS-GLRSEDEADYYCSTWDD-SLSVRVFGGGTKLTVLGQPKAA PSVTLFPPS-SEELQANKATLVCLVSDFYPGAVTVAWKADGSP-VKVGVETTKPSKQSN NKYAASSYLSLTPEQWKSHR-SYSCRVTHEGSTVEKTVAPAECS (SEQ ID NO:1724).

In one aspect, provided herein is an antibody comprising a $V_H$ and $V_L$ region as described herein, e.g., an antibody having a $V_H$ and $V_L$ region as set forth in Table 1A, or a variant thereof, that further comprises a human IgG1 constant region and/or a human lambda constant region. In some embodiments, the antibody comprises a heavy chain sequence ASTKGPSVFPLAPSSKSTSGGTAAL-GCLVKDYFPEPVTVSWNSGALTSGVHTFPAVL QSSG-LYS-LSSVVTVPSSSLGTQTYICNVNHKPSNTKVDKRVE-PKSCDKTHTCPPCPAP ELLGGPSVFLFPPKPKDTLMISRTPE-VTCVVVDVSHEDPEVKFNWYVDGVEVHNAK TKPREEQYN-STYRVVSVLTVLHQDWLNGKEYKCKVSNKALPA-PIEKTISKAKGQPR EPQVYTLPPSREEMTKNQVSLT-CLVKGFYPSDIAVEWESNGQPENNYKTTPPVLDSD GSFFLYSKLTVDKSRWQQGNVFSCSVMHEALHN-HYTQKSLSLSPG (SEQ ID NO:1721), or a variant thereof having at least 90% identity to SEQ ID NO:1721. In some embodiments, the antibody comprises the amino acid sequence of SEQ ID NO:1721 in which 1, 2, 3, 4, 5, 6, 7, 8, 9, or 10 amino acids are mutated, e.g., to modulate FcR binding, effector function, glycosylation, and/or stability. In some embodiments, the antibody comprises a light chain sequence GQPKAAPSVTLFPPS-SEELQANKATLVCLVSDFYP-GAVTVAWKADGSPVKVGVETT KPSKQSNNKYAAS-SYLSLTPEQWKSHRSYSCRVTHEGSTVEKTVAPAECS (SEQ ID NO:1722). In some embodiments, the antibody comprises a sequence having at least 90% identity, or at least 95% identity, or greater, to SEQ ID NO:1722.

In some embodiments, the $V_H$ region of an antibody of the present invention has a CDR1 comprising GFTFSKAWMS (SEQ ID NO:1), a CDR2 comprising RIKSVTDGETTDYAAPVKG (SEQ ID NO:9), and a CDR3 comprising TSSFCCRGGSCP-SHDTSYCGGQYKSYYYMDV (SEQ ID NO:21); and a $V_L$ region having a CDR1 comprising SGSSSNIGSSSVS (SEQ ID NO:48), a CDR2 comprising KNNQRPS (SEQ ID NO:59), and a CDR3 comprising STWDDSLSVRV (SEQ ID NO:68). In some embodiments, such an antibody comprises a human IgG1 and/or a human lambda constant region. In some embodiments, the $V_H$ region comprises the amino acid sequence of SEQ ID NO:8 and the $V_L$ region comprises the amino acid sequence of SEQ ID NO:29. In some embodiments, the antibody comprises a heavy chain sequence ASTKGPSVFPLAPSSKSTSGGTAAL-GCLVKDYFPEPVTVSWNSGALTSGVHTFPAVL QSSG-LYSLSSVVTVPSSSLGTQTYICNV-NHKPSNTKVDKRVEPKSCDKTHTCPPCPAP ELLGGPSVFLFPPKPKDTLMISRTPE-VTCVVVDVSHEDPEVKFNWYVDGVEVHNAK TKPREEQYN-STYRVVSVLTVLHQDWLNGKEYKCKVSNKALPA-PIEKTISKAKGQPR EPQVYTLPPSREEMTKNQVSLT-CLVKGFYPSDIAVEWESNGQPENNYKTTPPVLDSD GSFFLYSKLTVDKSRWQQGNVFSCSVMHEALHN-HYTQKSLSLSPG (SEQ ID NO:1721), or a variant thereof having at least 90% identity to SEQ ID NO:43. In some embodiments, the antibody comprises the amino acid sequence of SEQ ID NO:43 in which 1, 2, 3, 4, 5, 6, 7, 8, 9, or 10 amino acids are mutated, e.g., to modulate FcR binding, effector function, glycosylation, and/or stability. In some embodiments, the antibody comprises a light chain sequence GQPKAAPSVTLFPPS-SEELQANKATLVCLVSDFYP-GAVTVAWKADGSPVKVGVETT KPSKQSNNKYAAS-SYLSLTPEQWKSHRSYSCRVTHEGSTVEKTVAPAECS (SEQ ID NO:1722). In some embodiments, the antibody comprises a sequence having at least 90% identity, or at least 95% identity, or greater, to SEQ ID NO:1722.

Variant Binding Activity

Activity

A variant of an antibody that is useful for binding to tumor tissue through a binding interaction with an extracellular RNA-protein complex and/or for inducing an immune response, including an anti-tumor immune response, can be identified using a variety of assays. In a preferred embodiment, the binding target of the tumor-binding antibodies as described herein is present extracellularly by tumor cells when they are grown in vivo, but not present extracellularly for tumor cells grown under standard culture conditions in vitro. Binding assays to assess variant activity are therefore performed on tumor tissues or tumor cells ex vivo, e.g., on tumor cells that were grown as a tumor graft in a syngeneic (immune-matched) mouse in vivo then harvested and processed within 24-48 hrs. Binding can be assessed by any number of means including flow cytometry. However, in the present application, a tumor-binding antibody, when provided in a format that comprises an Fc region that binds to an FcγRIIa, also has the ability to engage the FcγRIIa. In one assay, variant binding activity is evaluated in an Fc receptor engagement assay. For purposes of testing variants, “engagement” of an Fc receptor occurs when a variant antibody binds to both a target tumor cell via its Fv region and an FcγR present on an immune cell via the antibody Fc region in such as manner so as to transduce a signal. If the Fc region is kept constant among variants that differ in their Fv regions, then the assay allows an evaluation of tumor binding activity across such variants in the context of potential signal transduction through a particular Fc region binding a particular Fc receptor. In some embodiments, binding of the antibody Fc region can result in clustering and/or internalization of the FcR, resulting in a luminescence signal in cells harbouring a NFAT-RE-Luciferase reporter construct.

In a preferred assay, binding activity of a variant antibody is assessed using ex vivo tumor cells as described above in an FcγRIIa engagement assay. In certain embodiments, binding of the antibody to both its target and FcγR leads to signal generation. In such an assay, $EC_{50}$ values are determined and in some embodiments, a delta activity value is also determined, as described below. In an illustrative assay, variants can be tested in a FcγRIIa-H Promega reporter assay. Other assays are also available, e.g., BPS Bioscience provides a similar assay using a CD32a reporter cell line. Alternative assays include using a CD16a reporter cell line and are available from either Promega or Invivogen.

The following assay is preferably used to measure the binding activity of antibodies that specifically bind to tumor-expressed target and activate FcγRIIa. This assay, the FcγRIIa-H ADCP assay, is available from Promega and employs Jurkat cells stably expressing human FcγRIIa-H (the high-affinity H131 variant) and NFAT-induced luciferase. Following engagement of an FcγR on Jurkat effector cells by the Fc region of a test antibody binding to a target cell, intracellular signals are generated in the Jurkat cells that result in NFAT-RE-mediated luciferase activity, which can be quantified. The assay used to analyze variants is detailed in the "Detailed Methodology" section below. The assay can be performed as further detailed below.

Binding activity is assessed by determining $EC_{50}$ values, and in some embodiments additionally determining delta activity, i.e., the difference in specific activity between lower and upper plateaus of the activation curve expressed as percent of activity of a selected antibody having known in vitro activity (see also, Example 8). In typical embodiments, $EC_{50}$ values are compared to a reference antibody. For purposes of this disclosure, an antibody comprising the $V_H$ and $V_L$ regions of AIP-160470 and a mouse IgG2a Fc region when testing ex vivo binding using a mouse tumor model, is employed as a reference antibody and included in an assay to assess variant activity relative to the reference antibody. The fold over $EC_{50}$ is calculated by dividing the $EC_{50}$ of the reference antibody by the $EC_{50}$ of the test antibody. Based on the resulting values, the antibodies were assigned to groups and given a ranking from 0-4 as follows: 0=(>500 nM); 1=<0.5; 2=0.5 to 2; 3=2 to 4; 4=>4.

The protocol for each step is provided below.

Inoculation and Growth of EMT6 Tumors in Balb/c Mice In Vivo

1. Suspend EMT6 cells in Waymouth's media without FBS to achieve 5×10$^6$ cells/ml
   a. 1 T225 cell culture flask will yield around 18-24×10$^6$ viable cells
2. Keep cells on ice for remainder of the procedure
3. Anaesthetize female, 8 week old BALB/c mice using isoflurane inhalation Using a 1 ml syringe with 25G needle, inject 200 μl cell suspension (1×10$^6$ cells total) subcutaneously into the shaved left flank of a mouse, ensuring that cells are not lost by reflux back into the syringe or leakage from the injection site during injection.

5. Check cell counts and viability after inoculation has been performed
   a. Should be in a 10% window
6. Monitor tumor growth using calipers Harvest EMT6 Tumors and Preparation of Ex Vivo Cell Bank 1. Harvest tumors once they reach 500-800 mm$^3$ as measured with calipers
2. Remove all surrounding skin and muscle
3. Transfer tumors into RPMI media on ice, containing Primocin at 1/500 dilution (100 ng/mL)
4. (Tumors can be pooled and volumes scaled up proportionately)
5. Prepare Tumor Digestion Mix (per 1 tumor)

a. 3.3 ml HBSS w $Ca^{2+}$ $Mg^{2+}$ b. 33 μl Collagenase A (final concentration: 0.2 mg/ml)

c. 33 μl Dispase II (final concentration: 0.8 mg/ml)

d. 17 μl DNase (final concentration: 0.02 mg/ml)

e. 6.6 μl Primocin f. Mix and filter through 0.22 micron cellulose acetate filter to sterilize 6. Recover tumors from RPMI. Cut tumors into small pieces and add 1 ml digestion mix per tumor
7. Incubate in either FACS tube with cap, 15, or 50 ml screwcap tube at 37° C. continuously rotating for 15 min
8. Allow cells to settle for 30 seconds
9. Carefully remove supernatant with 1 ml pipette and add to 3 ml of pure FBS on ice, containing Primocin at concentration of 100 μg/mL
10. Add another 1 ml of digestion mix and repeat 2× for a total of 3×
11. (you can cut the top off a 1 ml pipette tip and use it for mechanical dissociation in between the digestion steps)
12. After the last digestion, the cell suspension should pass through a 1 ml micropipette tip
13. Filter collected cells in FBS through 100 micron cell strainer into a new 50 ml tube
14. Spin, 300×g, 4° C., 10 min
15. Remove supernatant and resuspend cells in 1 ml pure FBS (with Primocin at 100 μg/mL)
16. Count and adjust cells to 6×10$^6$ cells/ml with FBS (with Primocin at 100 μg/mL)

a. Due to debris, cell counts with the Countess II or a Hemocytometer can be inaccurate i. Staining of nucleated cells with 1:1000 Draq5 (5 mM stock concentration) and counting on a flow cytometer in the APC channel is recommended ii. Addition of DAPI at 1:1000 allows for live cell gating of the nucleated population (Violet laser required)

1. Prepare staining solution by adding 1 ml of Draq5 (5 mM stock) and 1 μl of DAPI to 1 ml of PBS
2. Add 40 μl staining solution to a round bottom 96 well 3. Add 10 μl cell suspension and mix well
4. Incubate for 5 min at room temperature in the dark
5. Analyze sample by flow a. Gate on Draq5 (APC channel) positive cells first b. Determine DAPI (BV421 channel) negative cells within the Draq5 positive population 6. If flow cytometer can measure events/μl, you can calculate the cell number directly (Cytflex can do that)

7. If flow cytometer can not measure events/μl (like most BD instruments), you would need to add counting beads to get cell counts b. Viability should be above 75%

17. Resuspend cells at 4×10$^6$ cells/ml with FBS (with Primocin at 100 μg/mL)

18. Add equal amount of FBS containing 20% DMSO and 100 μg/mL Primocin

19. Mix well by pipetting up and down

20. Aliquot 1 ml (2×10$^6$ cells) of cell suspension into cryo tubes and freeze at −80° C.

a. Expected number of cells ~10×10$^6$ cells/tumor

21. Transfer to long-term liquid N2 storage the next day a. Take 1 sample vial and thaw according to the protocol "Thawing of ex vivo cells" b. Control cell counts Use of ex vivo EMT6 cells for engagement assay Thawing Ex Vivo Cells 1. Thaw a vial in the 37° C. water bath 2. Transfer the contents of the vial to a 50 ml conical tube 3. Add 19 mL of RPMI+2% FBS to the cells drop-by-drop, while swirling the suspension 4. Spin, 300×g, 4° C., 5 min 5. Resuspend in 1 mL PBS+2% FBS+2 mM EDTA 6. Spin, 300×g, 4° C., 5 min 7. Resuspend in 2 mL Assay Buffer (RPMI1640+4% Low IgG Serum)

8. Resuspend in 1 ml Assay Buffer

9. Count and adjust cells to 0.5×10$^6$ cells/ml in Assay Buffer a. Perform cell count as described in Section C; 16a FcγRIIa Engagement Assay (Promega Kit #G9991)

1. Prepare antibody serial dilutions in Assay Buffer at 1.5× excess.

a. 75 μl total assay volume b. 10$^{-6}$M starting concentration c. log dilutions in a 6 point dose response curve in triplicates 2. add 25 μl of the antibody dilution to a white, flat bottom 96 well plate.

a. use only inner 60 wells b. Fill unused wells with 75 μl assay buffer

3. Add 25 ul ex vivo cells to each well containing antibody dilution a. Gently tap the plate to mix cells with antibody 4. Incubate for 15 minutes at 37° C., 5% CO2.

5. Thaw a vial of FcγRIIa-H Effector cells (0.62 mL) (Promega kit 3G991) in the 37° C. water bath a. Remove vial from 37° C. as soon as it is thawed 6. Transfer the contents of the vial to a conical tube containing 5.3 mL of Assay Buffer 7. Mix by inverting the tube 4-5 times 8. Count and adjust cells to 0.5×10$^6$ cells/ml a. Cell counts can be performed using a regular cell counter or hemocytometer 9. Add 25 μl of the FcγRIIa-H effector cells to the opsonized target cells a. E:T ratio of 1:1

10. Gently shake the plates back and forth to mix the contents (75 μl total volume)

11. Incubate for 5 hours at 37° C., 5% CO2

12. After 5 hours, prepare the Bio-Glo Luciferase solution by adding the whole bottle of Bio-Glo™

Assay Buffer to the Bio-Glo Luciferase Assay substrate (10 mL total per kit).

13. remove plate from incubator

14. Add 75 ul of the Bio-Glo™ mix to each reaction well

15. Incubate at RT in the dark for 15 minutes

16. Measure luminescence in a suitable plate reader

17. Plot curves and calculate EC50 values

Reagents and Buffers

EMT6 complete media (Normal Growth Media, NGM)

Waymouth's MB 752/1 Medium+2 mM L-glutamine+15% fetal bovine serum (FBS)+1% pen/strep Assay Buffer RPMI1640+4% low IgG fetal bovine serum (FBS)

Collagenase A (Sigma-Aldrich, #10103586001)

1. Add HBSS with $Ca^{2+}$ $Mg^{2+}$ to create a stock solution of 50 mg/ml

2. Invert tube multiple times

3. Incubate for 5 min at room temperature

4. Aliquot into 1.5 ml snap-cap tube

5. Store at −20° C. for up to month

6. Avoid repeating freeze/thaw cycles

Dispase II (Sigma-Aldrich, #D4693-1G)

1. Reconstitute 1 g of Dispase II in 10 mL molecular biology grade water with 10 mM Sodium Acetate (pH 7.5) and 5 mM Calcium Acetate 2. Invert tube multiple times 3. Incubate for 60 min at room temperature 4. Aliquot into 1.5 ml snap-cap tube 5. Store at 4° C. for up to month DNAse (Sigma-Aldrich, #4536282001)

1. Add HBSS with $Ca^{2+}$ $Mg^{+}$ to create a stock solution of 2 mg/ml

2. Invert tube multiple times

3. Incubate for 5 min at room temperature

4. Aliquot into 1.5 ml snap-cap tube

5. Store at −20° C. for up to 7 days

6. Avoid repeating freeze/thaw cycles

An antibody can also be tested for anti-tumor function in vivo using an in vivo assay as described in the EXAMPLES section. A variant of an antibody as described herein typically has at least 50%, or at least 60%, or 70%, or greater, of the anti-tumor activity of a reference antibody as shown in Table 1 when evaluated under the same assay conditions to measure the anti-tumor activity in vivo. In some embodiments, an anti-tumor antibody exhibits improved activity, i.e., greater than 100% activity, compared to the reference antibody.

Antibody Binding Target

In one aspect, provided herein is an anti-tumor antibody that binds to tumor tissue. In some embodiments, an antibody of the present invention targets an extracellular RNA-protein complex that comprises mRNA and further comprises an mRNA binding protein. In typical embodiments, the tumor-binding antibody binds through a binding interaction with an extracellular RNA-protein complex. In some embodiments, the RNA-protein complex comprises polyadenylated RNA. In some embodiments, the RNA-protein complex comprises mRNA. Such a complex may also comprise other types of RNA such as ribosomal RNA and/or microRNA and/or long-noncoding RNA. In some embodiments, the RNA-protein complex comprises polyadenylated RNA and/or pre-mRNA. In some embodiments, the antibody binds directly to an RNA binding protein present in the RNA protein complex. In other embodiments, the antibody may bind a protein that interacts with an RNA binding protein. In other embodiments, binding of the antibody to the protein is dependent on RNA. In some embodiments, the antibody may bind simultaneously to RNA and a protein. In some embodiments, the antibody may bind to RNA. In other embodiments, binding of the antibody to RNA may be dependent on one or more RNA binding proteins bound to the RNA or be dependent on multiple proteins binding the RNA in a protein complex.

In some embodiments, an anti-tumor antibody provided herein binds to an extracellular RNA-protein complex that comprises one, two, three, or more proteins set forth in Table 3. In some embodiments, the extracellular RNA-protein complex comprises a polyadenylate binding protein family member, as further described below. In some embodiments, the extracellular RNA-protein complex comprises a polyadenylate binding protein family member and additional proteins, e.g., one or more proteins set forth in Table 3. In some embodiments, the antibody binds to a protein set forth in Table 3. In some embodiments, the protein is an RNA binding protein such as a polyadenylate binding protein family member, as further described below. In some embodiments, the tumor-binding antibody provided herein binds to an extracellular RNA-protein complex that comprises at one or more proteins selected from the following: ABCF1, ACIN1, ACLY, ADAR, AGO1, AGO2, AGO3, AHNAK, ATP2A2, ATXN2, BAG2, BOP1, BUB3, CAD, CASC3, CDCSL, CELF1, CLTA, CNBP, COPA, CRNKL1, DARS, $DDX_{17}$, $DDX_{18}$, $DDX_{21}$, $DDX_5$, $DDX_{54}$, $DDX_6$, $DHX_{15}$, $DHX_{30}$, $DHX_{36}$, $DHX_{57}$, $DHX_9$, DICER1, DKC1, DNTTIP2, EDC4, EEF1D, EEF2, EFTUD2, EIF2AK2, EIF2S1, EIF3D, EIF3E, EIF3I, EIF4A3, EIF4G1, EIF6, ELAVL1, EPRS, FAM120A, FBL, FMR1, FTSJ3, FUBP3, FUS, FXR1, FXR2, GAR1, GEMIN4, GNL3, GRSF1, GTPBP4, HEATR1, HIST1H1B, HIST1H1C, HIST1H3A, HNRNPA0, HNRNPA1, HNRNPA2B1, HNRNPA3, HNRNPAB, HNRNPC, HNRNPD, HNRNPDL, HNRNPF, HNRNPH1, HNRNPH3, HNRNPK, HNRNPL, HNRNPM, HNRNPR, HNRNPUL1, HNRNPUL2, IGF2BP1, IGF2BP2, IGF2BP3, ILF2, ILF3, KARS, KHDRBS1, L1RE1, LARP1, MAGOHB, MAK16, MAP1B, MATR3, MBNL1, MOV10, MRTO4, MVP, MYBBP1A, MYO1B, NAT10, NCL, NHP2, NIFK, NKRF, NOL11, NOL6, NOP2, NOP56, NOP58, PABPC1, PABPC4, PCBP2, PDCD11, PES1, PGD, PLEC, PPP1CB, PRKDC, PRKRA, PRPF19, PRPF4B, PRPF8, PRRC2C, PTBP1, PTBP3, PUM1, PURA, PURB, PWP1, PWP2, RAB14, RAB2A, RACK1, RALY, RAN, RBM14, RBM34, RBM4, RBM45, RBM8A, RBMX, RCC2, RPL10A, RPL11, RPL12, RPL13A, RPL14, RPL15, RPL17, RPL18, RPL18A, RPL19, RPL21, RPL22, RPL23, RPL23A, RPL24, RPL26, RPL27, RPL29, RPL3, RPL30, RPL32, RPL34, RPL35A, RPL36, RPL4, RPL5, RPL6, RPL7, RPL7A, RPL8, RPLP0, RPLP1, RPLP2, RPS11, RPS13, RPS17, RPS23, RPS24, RPS26, RPS27A, RPS3, RPS3A, RPSS, RPS6, RPS8, RPS9, RPSA, RRBP1, RRP1, RRP9, RRS1, RSL1D1, RTCB, RUVBL2, RYDEN, SART3, SF3B3, SKIV2L2, SLC3A2, SND1, SNRNP200, SNRNP70, SNRPB, SNRPD1, SNRPD2, SNRPD3, SON, SRP68, SRP72, SRPK1, SRPK2, SRRM2, SRSF1, SRSF10, SRSF2, SRSF3, SRSF6, SRSF7, SRSF9, SSB, STAU1, STAU2, STRAP, SYNCRIP, TARBP2, TARDBP, TCOF1, TCP1, THOC2, THOC6, TNRC6A, TOP1, TRA2A, TRA2B, TRIM25, TRIM56, TTN, U2AF2, UGDH, UPF1, UTP15, UTP18, UTP4, UTP6, WDR12, WDR36, WDR43, WDR46, WDR74, WDR75, XAB2, XRCCS, XRN2, $YBX_1$, $YBX_3$, YTHDC2, ZC3H7A, ZC3HAV1, ZCCHC3, and ZNF326.

In some embodiments, the polyadenylate binding protein family member is "polyadenylate-binding protein 1", also referred to as "poly(A) binding protein 1", (PABP-1) and RNA, e.g., poly(A)-containing RNA. PABP-1 associates with the 3' poly(A) tail of mRNA and is highly conserved among eukaryotic organisms. PABP-1 is encoded by the poly(A) binding protein cytoplasmic 1 (PABPC1) gene (see, e.g., the human PABPC1 gene sequence available under NCBI Ref. Sequence NM 002568.4). For purposes of the present invention, "PABPC1" is used interchangeably with "PABP-1" in referring to the polypeptide. Human PABPC1 polypeptide sequence information is available under UniProtKB accesson number P11940. Two isoforms produced by alternative splicing have been described. Isoform 1 is considered the canonical sequence and is 636 amino acids in length (see, e.g., NCBI Ref. Sequence NP 002559.2). Isoform 2 differs from the canonical sequence in that amino acids 447-553 are missing. A "human PABPC1 polypeptide" as used herein includes any PABPC1 polypeptide encoded by a human PABPC1 gene, which is localized to human chromosome 8q22.2-q23.

In some embodiments, provided herein is an antibody that targets a complex that comprises RNA, PABPC1, and/or additional RNA binding proteins to elicit an immune response and/or an anti-tumor response. Illustrative examples of additional RNA binding proteins that may be contained in such complexes include PABP family members, such as PABP-4 (also referred to as PABPC4). In some embodiments, the complex may comprise one or more proteins selected from the group consisting of the proteins listed in Table 3. In some embodiments, the one or more proteins are RNA binding proteins.

In some embodiments, a complex that comprises RNA and PABPC1, or RNA and PABPC1 and/or additional RNA binding proteins is a component of a ribonucleoprotein (RNP)-RNA condensate, which is a large, disordered configuration of denatured RNPs that form non-specific associations with one another and RNA to form a large assemblage that phase-separates to form distinguishable droplets (see, e.g., Hyman et al., *Annu Rev. Cell Dev. Biol.* 30:39-58, 2014). Thus, in some embodiments, an antibody that targets a complex comprising PABPC1 is administered to a patient having a tumor that contains ribonucleoprotein (RNP)-RNA condensate droplets that comprise the target RNA-PABPC1 complex.

In some embodiments, a complex that comprises RNA and PABPC1, or RNA and PABPC1 and/or additional RNA binding proteins is a component of a biomolecular condensate. Biomolecular condensates are two- and three dimensional compartments that concentrate specific collections of distinct molecules without an encapsulating membrane (Ditlev et al., *J. Mol. Biol.* 430: 4666-4684, 2018; Mullard, *Nature Reviews* 18:325, 2019). Thus, in some embodiments, an antibody that targets a complex comprising PABPC1 is administered to a patient having a tumor that contains a biomolecular condensate that comprises the target RNA-PABPC1 complex.

In some embodiments, a complex that comprises RNA and PABPC1, or RNA and PABPC1 and/or additional RNA binding proteins is a component of a stress granule or otherwise complexed with a stress granule. A "stress granule" as used herein refers to a non-membrane bound assembly or granule, typically formed in the cytoplasm, that is increased following stress. In some cases, stress granules form when cells shut off general protein synthesis in response to stress by, e.g., inhibiting translation and releasing mRNAs from disassembled polysomes into discreet cytoplasmic foci. Stress granules may comprise messenger ribonucleoproteins (mRNPs), including mRNA, small 40S ribosomal subunits, mRNA-associated translation inhibition complexes, and RNA-binding proteins. These stress granule proteins may determine the fate of specific transcripts that shuttle in and out of the stress granule, and also modulate various signaling cascades in stressed cells. PABPC1 is one of proteins that have been identified in stress granules (Aulas et al., *J. of Cell Science,* 130: 927-937, 2017). Thus, in some embodiments, an antibody that targets a complex comprising PABPC1 is administered to a patient having a tumor that contains stress granules that comprise the target RNA-PABPC1 complex.

In some embodiments, the ribonucleoprotein (RNP)-RNA condensate droplet, the stress granule, and/or the biomolecular condensate comprising the target RNA-PABPC1 complex comprises one or more proteins selected from Table 3. In some embodiments, the stress granules comprise one or more stress granule proteins selected from proteins in the group 1, 2, 3, or 4 in Table 3.

In some embodiments, the ribonucleoprotein (RNP)-RNA condensate droplet, the stress granule, and/or the biomolecular condensate comprising the target RNA-PABPC1 complex further comprise one or more oncofetal proteins. Non-limiting examples of oncofetal proteins include IGF2BP1 and IGF2BP3.

In some embodiments, the ribonucleoprotein (RNP)-RNA condensate droplet, the stress granule, and/or the biomolecular condensate comprising the target RNA-PABPC1 complex further comprise a cancer antigen, e.g., a cancer-testis antigen. One exemplary cancer-testis antigen is IGF2BP2.

In some embodiments, a complex that comprises RNA and PABPC1, or RNA and PABPC1 and/or additional RNA binding proteins is found extracellularly, e.g., the ribonucleoprotein (RNP)-RNA condensate droplet, granule, and/or biomolecular condensate (as described above) containing or bound to the target RNA-PABPC1 complex is outside of the cell. Thus, in some embodiments, an antibody that targets a complex comprising PABPC1 is administered to a patient having a tumor that has an extracellular complex comprising the target RNA-PABPC1 complex. In some embodiments, the patient is a mammal, e.g., a human.

In a further aspect, provided herein an antibody, e.g., having anti-tumor activity, that targets an RNA-protein complex that comprises a poly(A+) binding protein (PABP) closely related to PABPC1. Such RNA binding proteins are described, e.g., in Eliseeva et al, *Biochemistry* 78:1377-1391, 2013. These include six human poly(A+) binding proteins, which can be grouped as follows: cytoplasmic (PABPC3, PABPC4, PABPC4L (and PABPC1)), embryonic (ePABP, also referred to as PABPC1L), nuclear (PABPN1), and the X chromosome-encoded protein PABPC5. The gene encoding ePABP (also called PABPC1L) is on human chromosome 20. The PABPC1L protein has about 98% homology to PABPC1. The gene encoding PABPC3 is localized to 13q12-q13. The PABC3 protein (631 amino acids) has about 100% homology to the PABPC1 protein (636 amino acids). The gene encoding PABPC4 (there are three known isoforms) is localized to 1p34.2. All three PABPC4 isoforms have about 99% homology to PABPC1. The gene encoding PABC4L is localized to 4q28.3. The PABC4L protein has about 63% homology to PABPC1. The gene encoding PABPN1 is localized to 14q11.2. The PABPN1 protein has about 30% homology to PABPC1. The gene encoding PABPC5 is localized to Xq21.3. The PABPC5 protein has about 61% homology to PABPC1. The domain structure of these proteins comprises one or more RNA recognition motifs. Cytoplasmic PABPs have four such domains, typically in the N-terminal region. The C-terminal region of PABPC1, PABPC1L, PABPC3, and PABC4 contains a helical domain composed of five α-helices. The nuclear protein PABPN1 has only one RNA recognition motif.

RNA-PABPC4 Complexes

In some embodiments, provided herein is an antibody that targets a complex that comprises RNA and PABPC4 to elicit an anti-tumor response. In some embodiments, the complex comprises additional RNA binding proteins. In some embodiments, the complex is a component of a ribonucleoprotein (RNP)-RNA condensate. Thus, in some embodiments, an antibody that targets a complex comprising PABPC4 is administered to a patient having a tumor that contains ribonucleoprotein (RNP)-RNA condensate droplets that comprise the target RNA-PABPC4 complex.

In some embodiments, a complex that comprises RNA and PABPC4, which may further comprise additional RNA binding proteins, is a component of a biomolecular condensate. Thus, in some embodiments, an antibody that targets a complex comprising PABPC4 is administered to a patient having a tumor that contains a biomolecular condensate that comprises the target RNA-PABPC4 complex.

In some embodiments, a complex that comprises RNA and PABPC4, which may further comprise additional RNA binding proteins, is a component of a stress granule or otherwise complexed with a stress granule. Thus, in some embodiments, an antibody that targets a complex comprising PABPC4 is administered to a patient having a tumor that contains stress granules that comprise the target RNA-PABPC4 complex.

In some embodiments, the ribonucleoprotein (RNP)-RNA condensate droplet, the stress granule, and/or the biomolecular condensate comprising the target RNA-PABPC4 complex comprises one or more proteins selected from Table 5. In some embodiments, the stress granules comprise one or more stress granule proteins selected from proteins in the group 1, 2, 3, or 4 in Table 5.

In some embodiments, the ribonucleoprotein (RNP)-RNA condensate droplet, the stress granule, and/or the biomolecular condensate comprising a target RNA-PABPC4 complex further comprise one or more oncofetal proteins. Non-limiting examples of oncofetal proteins include IGF2BP1 and IGF2BP3.

In some embodiments, the ribonucleoprotein (RNP)-RNA condensate droplet, the stress granule, and/or the biomolecular condensate comprising a target RNA-PABPC4 complex further comprise a cancer antigen, e.g., a cancer-testis antigen. One exemplary cancer-testis antigen is IGF2BP2.

In some embodiments, a complex that comprises RNA and PABPC4, which may further comprise additional RNA binding proteins, is found extracellularly, e.g., the ribonucleoprotein (RNP)-RNA condensate droplet, granule, and/or biomolecular condensate (as described above) containing or bound to the target RNA-PABPC4 complex is outside of the cell. Thus, in some embodiments, an antibody that targets a complex comprising PABPC4 is administered to a patient having a tumor that has an extracellular complex comprising the target RNA-PABPC4 complex. In some embodiments, the patient is a mammal, e.g., a human.

RNA-PABPC3 Complexes

In some embodiments, provided herein is an antibody that targets a complex that comprises RNA and PABPC3 to elicit an anti-tumor response. In some embodiments, the complex comprises additional RNA binding proteins. In some embodiments, the complex is a component of a ribonucleoprotein (RNP)-RNA condensate. Thus, in some embodiments, an antibody that targets a complex comprising PABPC3 is administered to a patient having a tumor that contains ribonucleoprotein (RNP)-RNA condensate droplets that comprise the target RNA-PABPC3 complex.

In some embodiments, a complex that comprises RNA and PABPC3, which may further comprise additional RNA binding proteins, is a component of a biomolecular condensate. Thus, in some embodiments, an antibody that targets a complex comprising PABPC3 is administered to a patient having a tumor that contains a biomolecular condensate that comprises the target RNA-PABPC3 complex.

In some embodiments, a complex that comprises RNA and PABPC3, which may further comprise additional RNA binding proteins, is a component of a stress granule or otherwise complexed with a stress granule. Thus, in some embodiments, an antibody that targets a complex comprising PABPC3 is administered to a patient having a tumor that contains stress granules that comprise the target RNA-PABPC3 complex.

In some embodiments, the ribonucleoprotein (RNP)-RNA condensate droplet, the stress granule, and/or the biomolecular condensate comprising the target RNA-PABPC3 complex comprises one or more proteins selected from Table 5. In some embodiments, the stress granules comprise one or more stress granule proteins selected from proteins in the group 1, 2, 3, or 4 in Table 5.

In some embodiments, the ribonucleoprotein (RNP)-RNA condensate droplet, the stress granule, and/or the biomolecular condensate comprising a target RNA-PABPC3 complex further comprise one or more oncofetal proteins. Non-limiting examples of oncofetal proteins include IGF2BP1 and IGF2BP3.

In some embodiments, the ribonucleoprotein (RNP)-RNA condensate droplet, the stress granule, and/or the biomolecular condensate comprising a target RNA-PABPC3 complex further comprise a cancer antigen, e.g., a cancer-testis antigen. One exemplary cancer-testis antigen is IGF2BP2.

In some embodiments, a complex that comprises RNA and PABPC3, which may further comprise additional RNA binding proteins, is found extracellularly, e.g., the ribonucleoprotein (RNP)-RNA condensate droplet, granule, and/or biomolecular condensate (as described above) containing or bound to the target RNA-PABPC3 complex is outside of the cell. Thus, in some embodiments, an antibody that targets a complex comprising PABPC3 is administered to a patient having a tumor that has an extracellular complex comprising the target RNA-PABPC3 complex. In some embodiments, the patient is a mammal, e.g., a human.

RNA-PABPC4L Complexes

In some embodiments, provided herein is an antibody that targets a complex that comprises RNA and PABPC4L to elicit an anti-tumor response. In some embodiments, the complex comprises additional RNA binding proteins. In some embodiments, the complex is a component of a ribonucleoprotein (RNP)-RNA condensate. Thus, in some embodiments, an antibody that targets a complex comprising PABPC4L is administered to a patient having a tumor that contains ribonucleoprotein (RNP)-RNA condensate droplets that comprise the target RNA-PABPC4L complex.

In some embodiments, a complex that comprises RNA and PABPC4L, which may further comprise additional RNA binding proteins, is a component of a biomolecular condensate. Thus, in some embodiments, an antibody that targets a complex comprising PABPC4L is administered to a patient having a tumor that contains a biomolecular condensate that comprises the target RNA-PABPC4L complex.

In some embodiments, a complex that comprises RNA and PABPC4L, which may further comprise additional RNA binding proteins, is a component of a stress granule or otherwise complexed with a stress granule. Thus, in some embodiments, an antibody that targets a complex comprising PABPC4L is administered to a patient having a tumor that contains stress granules that comprise the target RNA-PABPC4L complex.

In some embodiments, the ribonucleoprotein (RNP)-RNA condensate droplet, the stress granule, and/or the biomolecular condensate comprising the target RNA-PABPC4L complex comprises one or more proteins selected from Table 5. In some embodiments, the stress granules comprise one or more stress granule proteins selected from proteins in the group 1, 2, 3, or 4 in Table 5.

In some embodiments, the ribonucleoprotein (RNP)-RNA condensate droplet, the stress granule, and/or the biomolecular condensate comprising a target RNA-PABPC4L complex further comprise one or more oncofetal proteins. Non-limiting examples of oncofetal proteins include IGF2BP1 and IGF2BP3.

In some embodiments, the ribonucleoprotein (RNP)-RNA condensate droplet, the stress granule, and/or the biomolecular condensate comprising a target RNA-PABPC4L complex further comprise a cancer antigen, e.g., a cancer-testis antigen. One exemplary cancer-testis antigen is IGF2BP2.

In some embodiments, a complex that comprises RNA and PABPC4L, which may further comprise additional RNA binding proteins, is found extracellularly, e.g., the ribonucleoprotein (RNP)-RNA condensate droplet, granule, and/or biomolecular condensate (as described above) containing or bound to the target RNA-PABPC4L complex is outside of the cell. Thus, in some embodiments, an antibody that targets a complex comprising PABPC4L is administered to a patient having a tumor that has an extracellular complex comprising the target RNA-PABPC4L complex. In some embodiments, the patient is a mammal, e.g., a human.

RNA-ePABP Complexes

In some embodiments, provided herein is an antibody that targets a complex that comprises RNA and ePABP to elicit an anti-tumor response. In some embodiments, the complex comprises additional RNA binding proteins. In some embodiments, the complex is a component of a ribonucleoprotein (RNP)-RNA condensate. Thus, in some embodiments, an antibody that targets a complex comprising ePABP is administered to a patient having a tumor that contains ribonucleoprotein (RNP)-RNA condensate droplets that comprise the target RNA-ePABP complex.

In some embodiments, a complex that comprises RNA and ePABP, which may further comprise additional RNA binding proteins, is a component of a biomolecular condensate. Thus, in some embodiments, an antibody that targets a complex comprising ePABP is administered to a patient having a tumor that contains a biomolecular condensate that comprises the target RNA-ePABP complex.

In some embodiments, a complex that comprises RNA and ePABP, which may further comprise additional RNA binding proteins, is a component of a stress granule or otherwise complexed with a stress granule. Thus, in some embodiments, an antibody that targets a complex comprising ePABP is administered to a patient having a tumor that contains stress granules that comprise the target RNA-ePABP complex.

In some embodiments, the ribonucleoprotein (RNP)-RNA condensate droplet, the stress granule, and/or the biomolecular condensate comprising the target RNA-ePABP complex comprises one or more proteins selected from Table 5. In some embodiments, the stress granules comprise one or more stress granule proteins selected from proteins in the group 1, 2, 3, or 4 in Table 5.

In some embodiments, the ribonucleoprotein (RNP)-RNA condensate droplet, the stress granule, and/or the biomolecular condensate comprising a target RNA-ePABP complex further comprise one or more oncofetal proteins. Non-limiting examples of oncofetal proteins include IGF2BP1 and IGF2BP3.

In some embodiments, the ribonucleoprotein (RNP)-RNA condensate droplet, the stress granule, and/or the biomolecular condensate comprising a target RNA-ePABP complex further comprise a cancer antigen, e.g., a cancer-testis antigen. One exemplary cancer-testis antigen is IGF2BP2.

In some embodiments, a complex that comprises RNA and ePABP, which may further comprise additional RNA binding proteins, is found extracellularly, e.g., the ribonucleoprotein (RNP)-RNA condensate droplet, granule, and/or biomolecular condensate (as described above) containing or bound to the target RNA-ePABP complex is outside of the cell. Thus, in some embodiments, an antibody that targets a complex comprising ePABP is administered to a patient having a tumor that has an extracellular complex comprising the target RNA-ePABP complex. In some embodiments, the patient is a mammal, e.g., a human.

RNA-PABPN1 Complexes

In some embodiments, provided herein is an antibody that targets a complex that comprises RNA and PABPN1 to elicit an anti-tumor response. In some embodiments, the complex comprises additional RNA binding proteins. In some embodiments, the complex is a component of a ribonucleoprotein (RNP)-RNA condensate. Thus, in some embodiments, an antibody that targets a complex comprising PABPN1 is administered to a patient having a tumor that contains ribonucleoprotein (RNP)-RNA condensate droplets that comprise the target RNA-PABPN1 complex.

In some embodiments, a complex that comprises RNA and PABPN1, which may further comprise additional RNA binding proteins, is a component of a biomolecular condensate. Thus, in some embodiments, an antibody that targets a complex comprising PABPN1 is administered to a patient having a tumor that contains a biomolecular condensate that comprises the target RNA-PABPN1 complex.

In some embodiments, a complex that comprises RNA and PABPN1, which may further comprise additional RNA binding proteins, is a component of a stress granule or otherwise complexed with a stress granule. Thus, in some embodiments, an antibody that targets a complex comprising PABPN1 is administered to a patient having a tumor that contains stress granules that comprise the target RNA-PABPN1 complex.

In some embodiments, the ribonucleoprotein (RNP)-RNA condensate droplet, the stress granule, and/or the biomolecular condensate comprising the target RNA-PABPN1 complex comprises one or more proteins selected from Table 5. In some embodiments, the stress granules comprise one or more stress granule proteins selected from proteins in the group 1, 2, 3, or 4 in Table 5.

In some embodiments, the ribonucleoprotein (RNP)-RNA condensate droplet, the stress granule, and/or the biomolecular condensate comprising a target RNA-PABPN1 complex further comprise one or more oncofetal proteins. Non-limiting examples of oncofetal proteins include IGF2BP1 and IGF2BP3.

In some embodiments, the ribonucleoprotein (RNP)-RNA condensate droplet, the stress granule, and/or the biomolecular condensate comprising a target RNA-PABPN1 complex further comprise a cancer antigen, e.g., a cancer-testis antigen. One exemplary cancer-testis antigen is IGF2BP2.

In some embodiments, a complex that comprises RNA and PABPN1, which may further comprise additional RNA binding proteins, is found extracellularly, e.g., the ribonucleoprotein (RNP)-RNA condensate droplet, granule, and/or biomolecular condensate (as described above) containing or bound to the target RNA-PABPN1 complex is outside of the cell. Thus, in some embodiments, an antibody that targets a complex comprising PABPN1 is administered to a patient having a tumor that has an extracellular complex comprising the target RNA-ePABP complex. In some embodiments, the patient is a mammal, e.g., a human.

RNA-PABPC5 Complexes

In some embodiments, provided herein is an antibody that targets a complex that comprises RNA and PABPC5 to elicit an anti-tumor response. In some embodiments, the complex comprises additional RNA binding proteins. In some embodiments, the complex is a component of a ribonucleoprotein (RNP)-RNA condensate. Thus, in some embodiments, an antibody that targets a complex comprising PABPC5 is administered to a patient having a tumor that contains ribonucleoprotein (RNP)-RNA condensate droplets that comprise the target RNA-PABPC5 complex.

In some embodiments, a complex that comprises RNA and PABPC5, which may further comprise additional RNA binding proteins, is a component of a biomolecular condensate. Thus, in some embodiments, an antibody that targets a complex comprising PABPC5 is administered to a patient having a tumor that contains a biomolecular condensate that comprises the target RNA-PABPC5 complex.

In some embodiments, a complex that comprises RNA and PABPC5, which may further comprise additional RNA binding proteins, is a component of a stress granule or otherwise complexed with a stress granule. Thus, in some embodiments, an antibody that targets a complex comprising PABPC5 is administered to a patient having a tumor that contains stress granules that comprise the target RNA-PABPC5 complex.

In some embodiments, the ribonucleoprotein (RNP)-RNA condensate droplet, the stress granule, and/or the biomolecular condensate comprising the target RNA-PABPC5 complex comprises one or more proteins selected from Table 5. In some embodiments, the stress granules comprise one or more stress granule proteins selected from proteins in the group 1, 2, 3, or 4 in Table 5.

In some embodiments, the ribonucleoprotein (RNP)-RNA condensate droplet, the stress granule, and/or the biomolecular condensate comprising a target RNA-PABPC5 complex further comprise one or more oncofetal proteins. Non-limiting examples of oncofetal proteins include IGF2BP1 and IGF2BP3.

In some embodiments, the ribonucleoprotein (RNP)-RNA condensate droplet, the stress granule, and/or the biomolecular condensate comprising a target RNA-PABPC5 complex further comprise a cancer antigen, e.g., a cancer-testis antigen. One exemplary cancer-testis antigen is IGF2BP2.

In some embodiments, a complex that comprises RNA and PABPC5, which may further comprise additional RNA binding proteins, is found extracellularly, e.g., the ribonucleoprotein (RNP)-RNA condensate droplet, granule, and/or biomolecular condensate (as described above) containing or bound to the target RNA-PABPC5 complex is outside of the cell. Thus, in some embodiments, an antibody that targets a complex comprising PABPC5 is administered to a patient having a tumor that has an extracellular complex comprising the target RNA-PABPC5 complex. In some embodiments, the patient is a mammal, e.g., a human.

RNA-PABP Vaccines

In some embodiments, a complex comprising RNA and one or more RNA binding proteins, e.g., PABPs, e.g., one or more of PABC1, PABPC3, PABPC4, PABC4L, ePABP, PABPN1, and/or PABPC5, is administered as a component of a cancer vaccine. In some embodiments, such a complex is co-adminstered with an immunomodulating agent, e.g., an adjuvant. Examples of immodulating agents include, but are not limited to, cytokines, growth factors, lymphotoxins, tumor necrosis factor (TNF), hematopoietic factors, interleukins (e.g., interleukin-1 (IL-1), IL-2, IL-3, IL-6, IL-10, IL-12, IL-15, an IL-15/IL-15Rα, e.g., sushi domain, complex, IL-18, and IL-21), colony stimulating factors (e.g., granulocyte-colony stimulating factor (G-CSF) and granulocyte macrophage-colony stimulating factor (GM-CSF), interferons (e.g., interferon-α, -β or -γ), erythropoietin and thrombopoietin, or a combination thereof. In some embodiments, the complex may be co-administered with an adjuvant, such as a Toll-like receptor (TLR) agonist, a C-type lectin receptor (CLR) agonist, a retinoic acid-inducible gene I-like receptor (RLR) agonist, a saponin, a polysaccharide such as chitin, chitosan, β-glucan, an ISCOM, QS-21, a stimulator of interferon genes (STING) agonist, or another immunopotentiating agent.

Antibody Formats

In a further aspect of the invention, an anti-tumor antibody in accordance with the disclosure may be an antibody fragment, e.g., a Fv, Fab, Fab', scFv, diabody, or $F(ab')_2$ fragment. In another embodiment, the antibody is a substantially full length antibody, e.g., an IgG antibody or other antibody class or isotype as defined herein. For a review of certain antibody fragments, see Hudson et al. Nat. Med. 9: 129-134 (2003). Antibody fragments can be made by various techniques, including but not limited to proteolytic digestion of an intact antibody as well as production by recombinant host cells.

In some embodiments, an anti-tumor antibody according to the present invention that is administered to a patient is an IgG of the IgG1 subclass. In some embodiments, such an antibody has a lambda light chain constant region.

In some embodiments an anti-tumor antibody in accordance with the present disclosure is in a monovalent format. In some embodiments, the anti-tumor antibody is in a fragment format, e.g., a Fv, Fab, Fab', scFv, diabody, or $F(ab')_2$ fragment.

In some embodiments, an antibody of the present disclosure comprises an Fc region that has effector function, e.g., exhibits antibody-dependent cellular cytotoxicity (ADCC), antibody-dependent cellular phagocytosis (ADCP), and/or complement-dependent cytotoxicity (CDC). In some embodiments, the Fc region may be an Fc region engineered to alter one or more functional properties of the antibody, such as serum half-life, complement fixation, Fc receptor binding, and/or ADCC. Accordingly, an Fc region can comprise additional mutations to increase or decrease effector functions, i.e., the ability to induce certain biological functions upon binding to an Fc receptor expressed on an immune cell. Immune cells include, but are not limited to, monocytes, macrophages, neutrophils, dendritic cells, eosinophils, mast cells, platelets, B cells, large granular lymphocytes, Langerhans' cells, natural killer (NK) cells, and cytotoxic T cells.

Examples of effector functions include, but are not limited to, Clq binding and CDC, Fc receptor binding (e.g., FcγR binding), ADCC, antibody-dependent cell-mediated phagocytosis (ADCP), down-regulation of cell surface receptors (e.g., B cell receptor), and B-cell activation. Effector functions may vary with the antibody class. For example, native human IgG1 and IgG3 antibodies can elicit ADCC and CDC activities upon binding to an appropriate Fc receptor present on an immune system cell; and native human IgG1, IgG2, IgG3, and IgG4 can elicit ADCP functions upon binding to the appropriate Fc receptor present on an immune cell.

In some embodiments, an Fc region described herein can include additional modifications that modulate effector function. Examples of Fc region amino acid mutations that modulate an effector function include, but are not limited to, one or more substitutions at positions 228, 233, 234, 235, 236, 237, 238, 239, 243, 265, 269, 270, 297, 298, 318, 326, 327, 329, 330, 331, 332, 333, and 334 (EU numbering scheme) of an Fc region.

Illustrative substitutions that decrease effector functions include the following: position 329 may have a mutation in which proline is substituted with a glycine or arginine or an amino acid residue large enough to destroy the Fc/Fcγ receptor interface that is formed between proline 329 of the Fc and tryptophan residues Trp 87 and Trp 110 of FcγRIII. Additional illustrative substitutions that decrease effector functions include S228P, E233P, L235E, N297A, N297D, and P331S. Multiple substitutions may also be present, e.g., L234A and L235A of a human IgG1 Fc region; L234A, L235A, and P329G of a human IgG1 Fc region; S228P and L235E of a human IgG4 Fc region; L234A and G237A of a human IgG1 Fc region; L234A, L235A, and G237A of a human IgG1 Fc region; V234A and G237A of a human IgG2 Fc region; L235A, G237A, and E318A of a human IgG4 Fc region; and S228P and L236E of a human IgG4 Fc region, to decrease effectors functions. Examples of substitutions that increase effector functions include, e.g., E333A, K326W/E333S, S239D/I332E/G236A, S239D/A330L/I332E, F243L, G236A, and S298A/E333A/K334A. Descriptions of amino acid mutations in an Fc region that can increase or decrease effector functions can be found in, e.g., Wang et al., Protein Cell. 9(1): 63-73, 2018; Saunders, Front Immunol. June 7, eCollection, 2019; Kellner et al., Transfus Med Hemother. 44(5): 327-336, 2017; and Lo et al., J Biol Chem. 292(9):3900-3908, 2017.

In some embodiments, an Fc region may have one or more amino acid substitutions that modulate ADCC, e.g., substitutions at positions 298, 333, and/or 334 of the Fc region, according to the EU numbering scheme. Specifically, S298A, E333A, and K334A can be introduced to an Fc region to increase the affinity of the Fc region to FcγRIIIa and decrease the affinity of the Fc region to FcγRIIa and FcγRIIb.

An Fc region can also comprise additional mutations to increase serum half-life. Through enhanced binding to the neonatal Fc receptor (FcRn), such mutations in an Fc region can improve the pharmacokinetics of the antibody. Examples of substitutions in an Fc region that increase the serum half-life of an antibody include, e.g., M252Y/S254T/T256E, T250Q/M428L, N434A, N434H, T307A/E380A/N434A, M428L/N434S, M252Y/M428L, D259I/V308F, N434S, V308W, V308Y, and V308F. Descriptions of amino acid mutations in an Fc region that can increase the serum half-life of an antibody can be found in, e.g., Dumet et al., MAbs. 26:1-10, 2019; Booth et al., MAbs. 10(7):1098-1110, 2018; and Dall'Acqua et al., J Biol Chem. 281(33):23514-24, 2006.

Furthermore, in some embodiments, an antibody of the disclosure may be chemically modified (e.g., one or more chemical moieties can be attached to the antibody) or be modified, e.g., produced in cell lines and/or in cell culture conditions to alter its glycosylation (e.g., hypofucosylation, afucosylation, or increased sialylation), to alter one or more functional properties of the antibody. For example, the antibody can be linked to one of a variety of polymers, for example, polyethylene glycol. In some embodiments, an antibody may comprises mutations to facilitate linkage to a chemical moiety and/or to alter residues that are subject to post-translational modifications, e.g., glycosylation.

In some embodiments, an anti-tumor antibody of the present invention is employed in a bispecific or multi-specific format, e.g., a tri-specific format. For example, in some embodiments, the antibody may be incorporated into a bispecific or multi-specific antibody that comprises a further binding domain that binds to the same or a different antigen.

Illustrative antigens that can be targeted by a further binding domain in a bispecific or multi-specific antibody that comprises a heavy and/or light chain variable domain of the present invention, include, but are not limited to, antigens on T cells to enhance T cell engagement and/or activate T cells. Illustrative examples of such an antigen include, but are not limited to, CD3, CD2, CD4, CD5, CD6, CD8, CD28, CD40L, CD44, IL-15Rα, CD122, CD132, or CD25. In some embodiments, the antigen is CD3. In some embodiments, the antigen is in a T cell activating pathway, such as a 4-1BB/CD137, CD137L, $OX_{40}$, $OX_{40}L$, GITRL, GITR, CD27, CD70, CD28, ICOS, HVEM, or LIGHT antigen.

In some embodiments, a bispecific or multispecific antibody comprising a heavy and/or light chain variable region of the present invention further comprises a binding domain that binds to a checkpoint antigen, PD1, PDL1, CTLA-4, ICOS, PDL2, IDO1, IDO2, B7-H3, B7-H4, BTLA, HVEM, TIM3, GAL9, GITR, HAVCR2, LAG3, KIR, LAIR1, LIGHT, MARCO, OX-40, SLAM, 2B4, CD2, CD27, CD28, CD30, CD40, CD70, CD80, CD86, CD137, CD160, CD39, VISTA, TIGIT, CGEN-15049, 2B4, CHK 1, CHK2, A2aR, or a B-7 family ligand or its receptor.

In some embodiments, a bispecific or multispecific antibody comprising a heavy and/or light chain variable region of the present invention further comprises a binding domain that targets a tumor-associated antigen. Illustrative tumor-associate antigens include, but are not limited to, EpCAM, HER2/neu, HER3/neu, G250, CEA, MAGE, proteoglycans, VEGF, VEGFREGFR, ErbB2, ErbB3, MET, IGF-1R, PSA, PSMA, EphA2, EphA3, EphA4, folate binding protein αVβ3-integrin, integrin α5β1 HLA, HLA-DR, ASC, CD1, CD2, CD4, CD6, CD7, CD8, CD11, CD13, CD14, CD19, CD20, CD21, CD22, CD23, CD24, CD30, CD33, CD37, CD40, CD41, CD47, CD52, c-erb-2, CALLA, MHCII, CD44v3, CD44v6, p9'7, ganglioside GM1, GM2, GM3, GD1a, GD1b, GD2, GD3, GT1b, GT3, GQ1, NY-ESO-1, $NFX_2$, $SSX_2$, $SSX_4$ Trp2, gp100, tyrosinase, Muc-1, telomerase, survivin, SLAMF7 EphG250, p53, CA125 MUC, Wue antigen, Lewis Y antigen, HSP-27, HSP-70, HSP-72, HSP-90, Pgp, PMEL17, MCSP, and cell surface targets GC182, GT468 or GT512.

In some embodiments, heavy and light chain variable regions of an anti-tumor antibody of the present invention may be incorporated into a chimeric antigen receptor construct, to generate a CAR-containing immune cell such as a T-cell or NK-cell. For example, in some embodiments, a first generation CAR joins a single-chain variable region from the antibody to a CD3zeta intracellular signaling domain of a CD3 T-cell receptor through hinge and transmembrane domains. In some embodiments, the CAR may contain co-stimulating domains, e.g., a second or third generation CAR may include an additional one or two-co-stimulating domains, such as 4-1BB, CD28, or OX-40). In additional embodiments, a CAR-containing cell, e.g., a CAR-T cell, may additionally be engineered to with an inducible expression component such as a cytokine, e.g., IL-12 or IL-15 to increase activation of CAR-T cells and also activate innate immune cells.

Generation of Antibodies

Anti-tumor antibodies as disclosed herein are commonly produced using vectors and recombinant methodology well known in the art (see, e.g., Sambrook & Russell, Molecular Cloning: A Laboratory Manual, Cold Spring Harbor Laboratory Press; Ausubel, Current Protocols in Molecular Biology). Reagents, cloning vectors, and kits for genetic manipulation are available from commercial vendors. Accordingly, in a further aspect of the invention, provided herein are isolated nucleic acids encoding a $V_H$ and/or $V_L$ region, or fragment thereof, of any of the anti-tumor antibodies as described herein; vectors comprising such nucleic acids and host cells into which the nucleic acids are introduced that are used to replicate the antibody-encoding nucleic acids and/or to express the antibodies. Such nucleic acids may encode an amino acid sequence containing the $V_L$ and/or an amino acid sequence containing the $V_H$ of the anti-tumor antibody (e.g., the light and/or heavy chains of the antibody). In some embodiments, the host cell contains (1) a vector containing a polynucleotide that encodes the $V_L$ amino acid sequence and a polynucleotide that encodes the $V_H$ amino acid sequence, or (2) a first vector containing a polynucleotide that encodes the $V_L$ amino acid sequence and a second vector containing a polynucleotide that encodes the $V_H$ amino acid sequence.

In a further aspect, the invention provides a method of making an anti-tumor antibody as described herein. In some embodiments, the method includes culturing a host cell as described in the preceding paragraph under conditions suitable for expression of the antibody. In some embodiments, the antibody is subsequently recovered from the host cell (or host cell culture medium).

Suitable vectors containing polynucleotides encoding antibodies of the present disclosure, or fragments thereof, include cloning vectors and expression vectors. While the cloning vector selected may vary according to the host cell intended to be used, useful cloning vectors generally have the ability to self-replicate, may possess a single target for a particular restriction endonuclease, and/or may carry genes for a marker that can be used in selecting clones containing the vector. Examples include plasmids and bacterial viruses, e.g., pUC18, pUC19, Bluescript (e.g., pBS SK+) and its derivatives, mp18, mp19, pBR322, pMB9, ColE1 plasmids, pCR1, RP4, phage DNAs, and shuttle vectors. These and many other cloning vectors are available from commercial vendors.

Expression vectors generally are replicable polynucleotide constructs that contain a nucleic acid of the present disclosure. The expression vector may replicable in the host cells either as episomes or as an integral part of the chromosomal DNA. Suitable expression vectors include but are not limited to plasmids and viral vectors, including adenoviruses, adeno-associated viruses, retroviruses, and any other vector.

Suitable host cells for expressing an anti-tumor antibody as described herein include both prokaryotic or eukaryotic cells. For example, an anti-tumor antibody may be produced in bacteria, in particular when glycosylation and Fc effector function are not needed. After expression, the antibody may be isolated from the bacterial cell paste in a soluble fraction and can be further purified. Alternatively, the host cell may be a eukaryotic host cell, including eukaryotic microorganisms, such as filamentous fungi or yeast, including fungi and yeast strains whose glycosylation pathways have been "humanized," resulting in the production of an antibody with a partially or fully human glycosylation pattern, vertebrate, invertebrate, and plant cells. Examples of invertebrate cells include insect cells. Numerous baculoviral strains have been identified which may be used in conjunction with insect cells. Plant cell cultures can also be utilized as host cells.

In some embodiments, vertebrate host cells are used for producing an anti-tumor antibody of the present disclosure. For example, mammalian cell lines such as a monkey kidney CV1 line transformed by SV40 (COS-7); human embryonic kidney line (293 or 293 cells as described, e.g., in Graham et al., J. Gen Virol. 36:59, 1977; baby hamster kidney cells (BHK); mouse sertoli cells (TM4 cells as described, e.g., in Mather, Biol. Reprod. 23:243-251, 1980 monkey kidney cells (CV1); African green monkey kidney cells (VERO-76); human cervical carcinoma cells (HELA); canine kidney cells (MDCK; buffalo rat liver cells (BRL 3A); human lung cells (W138); human liver cells (Hep G2); mouse mammary tumor (MMT 060562); TRI cells, as described, e.g., in Mather et al., Annals N.Y. Acad. Sci. 383:44-68, 1982; MRC 5 cells; and FS4 cells may be used to express an anti-tumor antibodies. Other useful mammalian host cell lines include Chinese hamster ovary (CHO) cells, including DHFR− CHO cells (Urlaub et al., *Proc. Natl. Acad. Sci. USA* 77:4216, 1980); and myeloma cell lines such as YO, NSO and Sp2/0. Host cells of the present disclosure also include, without limitation, isolated cells, in vitro cultured cells, and ex vivo cultured cells. For a review of certain mammalian host cell lines suitable for antibody production, see, e.g., Yazaki and Wu, Methods in Molecular Biology, Vol. 248 (B. K. C. Lo, ed., Humana Press, Totowa, N.J.), pp. 255-268, 2003.

In some embodiments, an antibody of the present invention is produced by a CHO cell line, e.g., the CHO-K1 cell line. One or more expresson plasmids can be introduced that encode heavy and light chain sequences. For example, in one embodiment, an expression plasmid encoding a heavy chain, e.g., SEQ ID NO:1723, and an expression plasmid encoding a light chain, e.g., SEQ ID NO:1724, are transfected into host cells as linearized plasmids at a ratio of 1:1 in the CHO-K1 host cell line using reagents such as Freestyle Max reagent. Fluorescence-activated cell sorting (FACS) coupled with single cell imaging can be used as a cloning method to obtain a production cell line.

A host cell transfected with an expression vector encoding an anti-tumor antibody of the present disclosure, or fragment thereof, can be cultured under appropriate conditions to allow expression of the polypeptide to occur. The polypeptides may be secreted and isolated from a mixture of cells and medium containing the polypeptides. Alternatively, the polypeptide may be retained in the cytoplasm or in a membrane fraction and the cells harvested, lysed, and the polypeptide isolated using a desired method.

In some embodiments, an anti-tumor antibody of the present disclosure can be produced by in vitro synthesis (see, e.g., Sutro Biopharma biochemical protein synthesis platform).

In some embodiments, provided herein is a method of generating variants of an anti-tumor antibody as disclosed herein. Thus, for example, a construct encoding a variant of a $V_H$ CDR3 as described herein can be modified and the $V_H$ region encoded by the modified construct can be tested for binding activity to EMT-6 cells and/or in vivo anti-tumor activity in the context of a $V_H$ region as described herein, that is paired with a $V_L$ region or variant region as described herein. Similarly, a construct encoding a variant of a $V_L$ CDR3 as described herein can be modified and the $V_L$ region encoded by the modified construct can be tested for binding to EMT-6 cells, or other tumor cells, and/or in vivo anti-tumor activity efficacy. Such an analysis can also be performed with other CDRs or framework regions and an antibody having the desired activity can then be selected.

Anti-Tumor Antibody Conjugates/Co-Stimulatory Agents

In a further aspect, an anti-tumor antibody of the present invention may be conjugated or linked to therapeutic and/or imaging/detectable moieties. For example, the anti-tumor antibody may be conjugated to a detectable marker, a cytotoxic agent, an immunomodulating agent, an imaging agent, a therapeutic agent, or an oligonucleotide. Methods for conjugating or linking antibodies to a desired molecule are well known in the art. The moiety may be linked to the antibody covalently or by non-covalent linkages.

In some embodiments, the antibody is conjugated to cytotoxic moiety or other moiety that inhibits cell proliferation. In some embodiments, the antibody is conjugated to a cytotoxic agent including, but not limited to, e.g., ricin A chain, doxorubicin, daunorubicin, a maytansinoid, taxol, ethidium bromide, mitomycin, etoposide, tenoposide, vincristine, vinblastine, colchicine, dihydroxy anthracin dione, methotrexact, actinomycin, a diphtheria toxin, exotoxin A from *Pseudomonas, Pseudomonas* exotoxin40, abrin, abrin A chain, modeccin A chain, alpha sarcin, gelonin, mitogellin, restrictocin, cobran venom factor, a ribonuclease, engineered Shiga toxin, phenomycin, enomycin, curicin, crotin, calicheamicin, *Saponaria officinalis* inhibitor, glucocorticoid, auristatin, auromycin, yttrium, bismuth, combrestatin, duocarmycins, dolastatin, cc1065, or a cisplatin. In some embodiments, the antibody may be linked to an agent such as an enzyme inhibitor, a proliferation inhibitor, a lytic agent, a DNA or RNA synthesis inhibitors, a membrane permeability modifier, a DNA metabolite, a dichloroethylsulfide derivative, a protein production inhibitor, a ribosome inhibitor, or an inducer of apoptosis. In some embodiments, the antibody is conjugated to a drug such as a topoisomeriase inhibitor, e.g., a topoisomeraise I inhibitor.

In some embodiments, an anti-tumor antibody of the invention is joined to a molecule that facilitates transport of the antibody across a biological membrane, e.g., by enhancing penetration of the membrane, facilitating protein translocation across membranes. Thus, for example, the antibody may be linked to a cell penetration agent, such as a cell-penetrating peptide. Examples of cell penetrating peptides include TAT, penetratin, polyarginine molecules, Kunitz domain-derived peptides, e.g., angiopep-2, SynB, buforin, transportan, amphiphathic peptides and others. In some embodiments, the antibody may be conjugated with a cationic molecule such as a polyamine. In some embodiments, the antibody may be conjugated to an agent that facilitates transport across the blood brain barrier, e.g., transcytosis. Thus, for example, the antibody may be conjugated to an agent that binds to endothelial cell receptors that are internalized, e.g., transferrin receptor, insulin receptor, insulin-like growth factor receptor, or a low-density lipoprotein receptor, and the like. In some embodiments, the antibody may be conjugated to a toxin facilitating entry of the antibody into the cytoplasm, e.g., Shiga toxin.

In some embodiments, an anti-tumor antibody is conjugated or co-adminstered with a polypeptide immunomodulating agent, e.g., an adjuvant. Examples of immodulating agents include, but are not limited to, cytokines, growth factors, lymphotoxins, tumor necrosis factor (TNF), hematopoietic factors, interleukins (e.g., interleukin-1 (IL-1), IL-2, IL-3, IL-6, IL-10, IL-12, IL-15, an IL-15/IL-15Rα, e.g., sushi domain, complex, IL-18, and IL-21), colony stimulating factors (e.g., granulocyte-colony stimulating factor (G-CSF) and granulocyte macrophage-colony stimulating factor (GM-CSF), interferons (e.g., interferon-α, -β or -γ), erythropoietin and thrombopoietin, or a combination thereof. In some embodiments, the antibody is linked or co-administered with an adjuvant, such as a Toll-like receptor (TLR) agonist, a C-type lectin receptor (CLR) agonist, a retinoic acid-inducible gene I-like receptor (RLR) agonist, a saponin, a polysaccharide such as chitin, chitosan, β-glucan, an ISCOM, QS-21, a stimulator of interferon genes (STING) agonist, or another immunopotentiating agent.

In some embodiments, the antibody may be linked to a radionuclide, an iron-related compound, a dye, a fluorescent agent, or an imaging agent. In some embodiments, an antibody may be linked to agents, such as, but not limited to, metals; metal chelators; lanthanides; lanthanide chelators; radiometals; radiometal chelators; positron-emitting nuclei; microbubbles (for ultrasound); liposomes; molecules microencapsulated in liposomes or nanosphere; monocrystalline iron oxide nanocompounds; magnetic resonance imaging contrast agents; light absorbing, reflecting and/or scattering agents; colloidal particles; fluorophores, such as near-infrared fluorophores.

Methods of Inducing an Immune Response

In a further aspect, provided herein are methods of inducing an immune response by administering a tumor-binding antibody as described herein to a subject that has a tumor that comprises an extracellular RNA-protein complex to which the tumor-binding antibody binds. In some embodiments, the tumor-binding antibody is an antibody set forth in Table 1 or Table 2, or a variant thereof as described above.

An immune response induced by administration of an antibody as described herein can be either an innate or adaptive immune response. In some embodiments, the antibody directly activates an immune response directly, e.g., via binding of the antibody to a target tumor cell and engagement with an Fc receptor on an effector cell such that the effector cell is activated. In some embodiments, the antibody indirectly activates an immune response by inducing immune responses that are initiated by antibody binding to the target cell and an effector cell with subsequent induction of downstream immune responses. In some embodiments, the antibody activates monocytes, myeloid cells, and/or NK cells, e.g., macrophages, neutrophils, dendritic cells, mast cells, basophils, eosinophile, and/or NK cells. In some embodiments, the antibody activates T lymphocytes and/or B cells.

Treatment of Cancer

In a further aspect, a tumor-binding antibody as provided herein, e.g., an antibody set forth in Table 1 or a variant thereof as described above, can be used and a therapeutic agent to treat cancer. In some aspects, the disclosure additionally provides methods of identifying subjects who are candidates for treatment with an anti-tumor antibody having anti-tumor effects. Thus, in one embodiment, the invention provides a method of identifying a patient who has tumor cells that binds to an anti-tumor antibody of the present disclosure. In some embodiments, the tumor sample is from a primary tumor. In alternative embodiments, the tumor sample is a metastatic lesion. Binding of antibody to tumor cells through a binding interaction with an extracellular RNA-protein complex can be measured using any assay, such as immunohistochemistry or flow cytometry. In some embodiments, binding of antibody to at least 0.2%, 0.5%, or 1%, or at least 5% or 10%, or at least 20%, 30%, or 50%, of the tumor cells in a sample may be used as a selection criteria for determining a patient to be treated with an anti-tumor antibody as described herein. In other embodiments, analysis of components of the blood, e.g., circulating exosomes and/or extracellular RNA-protein complex, is used to identify a patient whose tumor cells are generating an extracellular RNA-protein complex.

Any number of cancers can be treated with an anti-tumor antibody of the present invention. In some embodiments, the cancer is a carcinoma or a sarcoma. In some embodiments, the cancer is a hematological cancer. In some embodiments, the cancer is breast cancer, prostate cancer, testicular cancer, renal cell cancer, bladder cancer, ovarian cancer, cervical cancer, endometrial cancer, lung cancer, colorectal cancer, anal cancer, pancreatic cancer, gastric cancer, esophageal cancer, hepatocellular cancer, head and neck cancer, a brain cancer, e.g., glioblastoma, melanoma, or a bone or soft tissue sarcoma. IN one embodiments, the cancer is acral melanoma. In some embodiments, the cancer is acute lymphoblastic leukemia, acute myeloid leukemia, adrenocortical carcinoma, astrocytoma, basal-cell carcinoma, bile duct cancer, bone tumor, brainstem glioma, cerebellar astrocytoma, cerebral astrocytoma, ependymoma, medulloblastoma, supratentorial primitive neuroectodermal tumors, visual pathway and hypothalamic glioma, bronchial adenomas, Burkitt's lymphoma, central nervous system lymphoma, cerebellar astrocytoma, chondrosarcoma, chronic lymphocytic leukemia, chronic myelogenous leukemia, chronic myeloproliferative disorders, colon cancer, cutaneous T-cell lymphoma, desmoplastic small round cell tumor, endometrial cancer, ependymoma, epitheliod hemangioendothelioma (EHE), esophageal cancer, Ewing's sarcoma, extracranial germ cell tumor, extragonadal germ cell tumor, extrahepatic bile duct cancer, a cancer of the eye, intraocular melanoma, retinoblastoma, gallbladder cancer, gastrointestinal carcinoid tumor, gastrointestinal stromal tumor (GIST), germ cell tumor, gestational trophoblastic tumor, gastric carcinoma, hairy cell leukemia, hepatocellular carcinoma, Hodgkin lymphoma, hypopharyngeal cancer, hypothalamic and visual pathway glioma, childhood, intraocular melanoma, islet cell carcinoma, Kaposi sarcoma, kidney cancer, laryngeal cancer, leukaemias, lip and oral cavity cancer, liposarcoma, liver cancer, non-small cell lung cancer, small-cell lung cancer, lymphomas, macroglobulinemia, male breast cancer, malignant fibrous histiocytoma of bone, medulloblastoma, Merkel cell cancer, mesothelioma, metastatic squamous neck cancer, mouth cancer, multiple endocrine neoplasia syndrome, multiple myeloma, mycosis fungoides, myelodysplastic syndromes, myelogenous leukemia, myeloid leukemia, adult acute, myeloproliferative disorders, chronic, myxoma, nasal cavity and paranasal sinus cancer, nasopharyngeal carcinoma, neuroblastoma, non-Hodgkin lymphoma, oligodendroglioma, oral cancer, oropharyngeal cancer, osteosarcoma, ovarian epithelial cancer, ovarian germ cell tumor, ovarian low malignant potential tumor, paranasal sinus and nasal cavity cancer, parathyroid cancer, penile cancer, pharyngeal cancer, pheochromocytoma, pineal astrocytoma, pineal germinoma, pineoblastoma, supratentorial primitive neuroectodermal tumors, pituitary adenoma, plasma cell neoplasia, pleuropulmonary blastoma, primary central nervous system lymphoma, rectal cancer, renal cell carcinoma, retinoblastoma, rhabdomyosarcoma, salivary gland cancer, Ewing sarcoma, Kaposi sarcoma, soft tissue sarcoma, uterine sarcoma, Sézary syndrome, non-melanoma skin cancer, melanoma, small intestine cancer, squamous cell carcinoma, squamous neck cancer, stomach cancer, cutaneous T-Cell lymphoma, throat cancer, thymoma, thyroid cancer, transitional cell cancer of the renal pelvis and ureter, trophoblastic tumor, gestational, urethral cancer, uterine cancer, vaginal cancer, vulvar cancer, Waldenström macroglobulinemia, or Wilms tumor.

In some embodiments, the cancer is lung cancer, e.g., non-small cell lung adenocarcinoma or squamous cell carcinoma; breast cancer, e.g., Triple$^-$, ER/PR$^+$Her2$^-$, ER/PR$^-$ Her2$^+$, or Triple$^-$; colorectal cancer, e.g., adenocarcinoma, mucinous adenocarcinoma, or papillary adenocarcinoma; esophageal cancer; stomach cancer; kidney cancer, e.g., kidney clear cell cancer; ovarian cancer, e.g., ovarian endometrioid carcinoma, ovarian mucinous cystadenocarcinoma, or ovarian serous cystadenomcarcinoma; melanoma, e.g., acral melanoma, cutaneous melanoma, or mucosal melanoma; uterine or cervical cancer; liver cancer, e.g., hepatocellular carcinoma or bile duct carcinoma; bladder cancer, e.g., transitional or urothelial bladder cancer; or testicular cancer.

In one aspect, methods of the disclosure comprise administering an anti-tumor antibody, e.g., an antibody set forth in Table 1 or a variant thereof as described above, as a pharmaceutical composition to a cancer patient in a therapeutically effective amount using a dosing regimen suitable for treatment of the cancer. The composition can be formulated for use in a variety of drug delivery systems. One or more physiologically acceptable excipients or carriers can also be included in the compositions for proper formulation. Suitable formulations for use in the present invention are found, e.g., in Remington: The Science and Practice of Pharmacy, 21st Edition, Philadelphia, Pa. Lippincott Williams & Wilkins, 2005.

The anti-tumor antibody is provided in a solution suitable for administration to the patient, such as a sterile isotonic aqueous solution for injection. The antibody is dissolved or suspended at a suitable concentration in an acceptable carrier. In some embodiments the carrier is aqueous, e.g., water, saline, phosphate buffered saline, and the like. The compositions may contain auxiliary pharmaceutical substances as required to approximate physiological conditions, such as pH adjusting and buffering agents, tonicity adjusting agents, and the like.

The pharmaceutical compositions are administered to a patient in an amount sufficient to cure or at least partially arrest the disease or symptoms of the disease and its complications. An amount adequate to accomplish this is defined as a "therapeutically effective dose." A therapeutically effective dose is determined by monitoring a patient's response to therapy. Typical benchmarks indicative of a therapeutically effective dose include the amelioration of symptoms of the disease in the patient. Amounts effective for this use will depend upon the severity of the disease and the general state of the patient's health, including other factors such as age, weight, gender, administration route, etc. Single or multiple administrations of the antibody may be administered depending on the dosage and frequency as required and tolerated by the patient. In any event, the methods provide a sufficient quantity of anti-tumor antibody to effectively treat the patient.

An anti-tumor antibody can be administered by any suitable means, including, for example, parenteral, intrapulmonary, and intranasal, administration, as well as local administration, such as intratumor administration. Parenteral infusions include intramuscular, intravenous, intraarterial, intraperitoneal, or subcutaneous administration. In some embodiments, the antibody may be administered by insufflation. In an illustrative embodiment, the antibody may be stored at 10 mg/ml in sterile isotonic aqueous saline solution for injection at 4° C. and is diluted in either 100 ml or 200 ml 0.9% sodium chloride for injection prior to administration to the patient. In some embodiments, the antibody is administered by intravenous infusion over the course of 1 hour at a dose of between 0.01 and 25 mg/kg. In other embodiments, the antibody is administered by intravenous infusion over a period of between 15 minutes and 2 hours. In still other embodiments, the administration procedure is via sub-cutaneous bolus injection.

The dose of antibody is chosen in order to provide effective therapy for the patient and is in the range of less than 0.01 mg/kg body weight to about 25 mg/kg body weight or in the range 1 mg-2 g per patient. Preferably the dose is in the range 0.1-10 mg/kg or approximately 50 mg-1000 mg/patient. The dose may be repeated at an appropriate frequency which may be in the range once per day to once every three months, or every six months, depending on the pharmacokinetics of the antibody (e.g., half-life of the antibody in the circulation) and the pharmacodynamic response (e.g., the duration of the therapeutic effect of the antibody). In some embodiments, the in vivo half-life of between about 7 and about 25 days and antibody dosing is repeated between once per week and once every 3 months or once every 6 months. In other embodiments, the antibody is administered approximately once per month.

In an illustrative embodiment, the antibody may be stored at 10 mg/ml or 20 mg/ml in a sterile isotonic aqueous solution. The solution can comprise agents such as buffering agents and stabilizing agents. For example, in some embodiments, a buffering agent such as histidine is included to maintain a formulation pH of about 5.5. Additional reagents such as sucrose or alternatives can be added to prevent aggregation and fragmentation in solution and during freezing and thawing. Agents such as polysorbate 80 or an alternative can be included to lower surface tension and stabilizes the antibody against agitation-induced denaturation and air-liquid and ice-liquid surface denaturation. In some embodiments, the solution for injection is stored at 4° C. and is diluted in either 100 ml or 200 ml 0.9% sodium chloride for injection prior to administration to the patient.

In some embodiments, antibody for IV administration, e.g., an antibody having a heavy chain sequence of SEQ ID NO:1723 and a light chain sequence of SEQ ID NO:1724, is formulated at a target concentration of 20 mg/mL in 20 mM histidine buffer, 8% (w/v) sucrose and 0.02% (w/v) polysorbate 80, pH 5.5.

An anti-tumor antibody of may be administered with one or more additional therapeutic agents, e.g., radiation therapy, chemotherapeutic agents and/or immunotherapeutic agents.

In some embodiments, an anti-tumor antibody can be administered in conjunction with an agent that targets an immune checkpoint antigen. In one aspect, the agent is a biologic therapeutic or a small molecule. In another aspect, the agent is a monoclonal antibody, a humanized antibody, a human antibody, a fusion protein or a combination thereof. In certain embodiments, the agents inhibit, e.g., by blocking ligand binding to receptor, a checkpoint antigen that may be PD1, PDL1, CTLA-4, ICOS, PDL2, IDO1, IDO2, B7-H3, B7-H4, BTLA, HVEM, TIM3, GAL9, GITR, HAVCR2, LAG3, KIR, LAIR1, LIGHT, MARCO, OX-40, SLAM, 2B4, CD2, CD27, CD28, CD30, CD40, CD70, CD80, CD86, CD137 (4-1BB), CD160, CD39, VISTA, TIGIT, a SIGLEC, CGEN-15049, 2B4, CHK1, CHK2, A2aR, B-7 family ligands or their receptors, or a combination thereof. In some embodiments, the agent targets PD-1, e.g., an antibody that blocks PD-L1 binding to PD-1 or otherwise inhibits PD-1. In some embodiments, the agent targets CTLA-4. In some embodiments, the agent targets LAG3. In some embodiments, the agent targets TIM3. In some embodiments, the agents target ICOS.

In some embodiments, an anti-tumor antibody can be administered in conjunction with a therapeutic antibody, such as an antibody that targets a tumor cell antigen. Examples of therapeutic antibodies include as rituximab, trastuzumab, tositumomab, ibritumomab, alemtuzumab, atezolizumab, avelumab, durvalumab, pidilizumab, AMP-224, AMP-514, PDR001, cemiplimab, BMS-936559, CK-301, epratuzumab, bevacizumab, elotuzumab, necitumumab, blinatumomab, brentuximab, cetuximab, daratumumab, denosumab, dinutuximab, gemtuzumab ibritumomab ipilimumab, nivolumab, obinutuzumab, ofatumumab, ado-trastuzumab, panitumumab, pembrolizumab, pertuzumab, ramucirumab, and ranibizumab.

In some embodiments, an anti-tumor antibody is administered with a chemotherapeutic agent. Examples of cancer chemotherapeutic agents include alkylating agents such as thiotepa and cyclophosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethylenethiophosphaoramide and trimethylolomelamine; nitrogen mustards such as chlorambucil, chlomaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins, cactinomycin, calicheamicin, carabicin, caminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; antimetabolites such as methotrexate and 5-fluorouracil; folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine, androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; amsacrine; bestrabucil; bisantrene; edatraxate; defofamine; demecolcine; diaziquone; elformithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; razoxane; sizofiran; spirogermanium; tenuazonic acid; triaziquone; 2,2',2"-trichlorotriethylamine; urethan; vindesine; dacarbazine; mannomustine; mitobronitol; mitolactol; pipobroman; gacytosine; arabinoside; cyclophosphamide; thiotepa; taxoids, e.g. paclitaxel and doxetaxel; chlorambucil; gemcitabine; 6-thioguanine; mercaptopurine; methotrexate; platinum analogs such as cisplatin and carboplatin; vinblastine; docetaxel, platinum; etoposide (VP-16); ifosfamide; mitomycin C; mitoxantrone; vincristine; vinorelbine; navelbine; novantrone; teniposide; daunomycin; aminopterin; xeloda; ibandronate; CPT-11; topoisomerase inhibitor RFS 2000; difluoromethylomithine (DMFO); retinoic acid derivatives such as bexarotene, alitretinoin; denileukin diftitox; esperamicins; capecitabine; and pharmaceutically acceptable salts, acids or derivatives of any of the above. Also included in this definition are anti-hormonal agents that act to regulate or inhibit hormone action on tumors such as anti-estrogens including for example tamoxifen, raloxifene, mifepristone, aromatase inhibiting 4(5)-imidazoles, 4-hydroxytamoxifen, trioxifene, keoxifene, LY 1 17018, onapristone, and toremifene (Fareston); and anti-androgens such as flutamide, nilutamide, bicalutamide, leuprolide, and goserelin; and pharmaceutically acceptable salts, acids or derivatives of any of the above. Further cancer therapeutic agents include sorafenib and other protein kinase inhibitors such as afatinib, axitinib, crizotinib, dasatinib, erlotinib, fostamatinib, gefitinib, imatinib, lapatinib, lenvatinib, mubritinib, nilotinib, pazopanib, pegaptanib, ruxolitinib, vandetanib, vemurafenib, and sunitinib; sirolimus (rapamycin), everolimus and other mTOR inhibitors. Examples of additional chemotherapeutic agents include topoisomerase I inhibitors (e.g., irinotecan, topotecan, camptothecin and analogs or metabolites thereof, and doxorubicin); topoisomerase II inhibitors (e.g., etoposide, teniposide, and daunorubicin); alkylating agents (e.g., melphalan, chlorambucil, busulfan, thiotepa, ifosfamide, carmustine, lomustine, semustine, streptozocin, decarbazine, methotrexate, mitomycin C, and cyclophosphamide); DNA intercalators (e.g., cisplatin, oxaliplatin, and carboplatin); DNA intercalators and free radical generators such as bleomycin; and nucleoside mimetics (e.g., 5-fluorouracil, capecitibine, gemcitabine, fludarabine, cytarabine, mercaptopurine, thioguanine, pentostatin, and hydroxyurea). Illustrative chemotherapeutic agents additionally include paclitaxel, docetaxel, and related analogs; vincristine, vinblastin, and related analogs; thalidomide, lenalidomide, and related analogs (e.g., CC-5013 and CC-4047); protein tyrosine kinase inhibitors (e.g., imatinib mesylate and gefitinib); proteasome inhibitors (e.g., bortezomib); NF-κB inhibitors, including inhibitors of IκB kinasel and other inhibitors of proteins or enzymes known to be upregulated, over-expressed or activated in cancers, the inhibition of which down regulates cell replication. Additional agents include asparaginase and a *Bacillus* Calmete-Guérin preparation.

In some embodiments, an anti-tumor antibody as described herein is administered after, or at the same time, as a therapeutic agent, e.g., a chemotherapeutic agent, such as doxorubicin, that induces stress granules ("SG-inducing agent"). Increasing the amount of stress granules in cancer cells can promote targeting the tumor cells by the anti-tumor antibody. Other exemplary therapeutic agents that can induce stress granules include pyrimidine analogs (e.g., 5-FU, under trade names of Adrucil®, Carac®, Efudex®, Efudix®); protease inhibitors (e.g., Bortezomib, under the trade name of Velcade®); kinase inhibitors (e.g., Sorafenib and Imatinib, under the trade names of Nexavar® and Gleevec®, respectively); Arsenic compounds (e.g., Arsenic trioxide, under the trade name of Trisenox®); Platinum-based compounds that induce DNA damage (e.g., Cisplatin and Oxaliplatin®, under the trade names of Platinol® and Eloxatin®, respectively); agents that disrupt microtubules (e.g., Vinblastin, under the trade name of Velban® or Alkabban-AQ®; vincristin, under the trade name of Vincasar®, Marqibo®, or Oncovin®; Vinorelbin, under the trade name of Navelbie); topoisomerase II inhibitor (e.g., Etoposide, under the trade name of Etopophos, Toposar®, VePesid®); and agents that induce DNA damage, e.g., irradiation. A number of exemplary therapeutic agents that can induce stress granules formation are disclosed in Mahboubi et al., *Biochimica et Biophysica Acta* 1863 (2017) 884-895.

Various combinations with the anti-tumor antibody and the SG-inducing agent (or a combination of such agents) described herein may be employed to treat a cancer patient. By "combination therapy" or "in combination with", it is not intended to imply that the therapeutic agents must be administered at the same time and/or formulated for delivery together, although these methods of delivery are within the scope described herein. The anti-tumor antibody and the SG-inducing agent can be administered following the same or different dosing regimen. In some embodiments, the anti-tumor antibody and the SG-inducing agent is administered sequentially in any order during the entire or portions of the treatment period. In some embodiments, the anti-tumor antibody and the SG-inducing agent is administered simultaneously or approximately simultaneously (e.g., within about 1, 5, 10, 15, 20, or 30 minutes of each other). In still other embodiments, the SG-inducing agent may be administered 1, 2, 3, 4, 5, 6, 7, 8, 9, 10, or more days before administration of the anti-tumor antibody. In some embodiments, the SG-inducing agent is administered from 1 to 4 weeks, or longer, before the anti-tumor antibody is administered.

An anti-tumor antibody may also be administered to a cancer patient in conjunction with a cell based therapy, such as natural killer (NK) cell therapy or a cancer vaccine. In some instances, a cancer vaccine is a peptide-based vaccine, a nucleic acid based vaccine, a cell-based vaccine, a virus-based or viral fragment based vaccine or an antigen presenting cell (APC) based vaccine (e.g. dendritic cell based vaccine). Cancer vaccines include Gardasil®, Cervarix®, sipuleucel-T (Provenge®), NeuVax™, HER-2 ICD peptide-based vaccine, HER-2/neu peptide vaccine, AdHER2/neu dendritic cell vaccine, HER-2 pulsed DC1 vaccine, Ad-sig-hMUC-1/ecdCD40L fusion protein vaccine, MVX-ONCO-1, hTERT/survivin/CMV multipeptide vaccine, E39, J65, P10s-PADRE, rV-CEA-Tricom, GVAX®, Lucanix®, HER2 VRP, $AVX_{901}$, ONT-10, ISA1O1, ADXS1 1-001, VGX-3100, INO-9012, GSK1437173A, BPX-501, AGS-003, IDC-G305, HyperAcute®-Renal (HAR) immunotherapy, Prevenarl3, MAGER-3.A1, NA17.A2, DCVax-Direct, latent membrane protein-2 (LMP2)-loaded dendritic cell vaccine (NCT02115126), HS410-101 (NCT02010203, Heat Biologies), EAU RF 2010-01 (NCT01435356, GSK), 140036 (NCT02015104, Rutgers Cancer Institute of New Jersey), 130016 (NCTO 1730118, National Cancer Institute), MVX-201101 (NCT02193503, Maxivax SA), ITL-007-ATCR-MBC (NCT01741038, Immunovative Therapies, Limited), CDR0000644921 (NCT00923143, Abramson cancer center of the University of Pennsylvania), SuMo-Sec-01 (NCT00108875, Julius Maximilians Universitaet Hospital), or MCC-15651 (NCT01176474, Medarex, Inc, BMS).

In some embodiments, an anti-tumor antibody of the present invention may be administered with an agent, e.g., a corticosteroid, that mitigates side-effects resulting from stimulation of the immune system.

In the context of the present invention a therapeutic agent that is administered in conjunction with an anti-tumor antibody of the present invention can be administered prior to administrations of the anti-tumor antibody or after administration of the anti-tumor antibody. In some embodiments, an anti-tumor antibody may be administered at the same time as the additional therapeutic agent.

The following examples are offered for illustrative purposes, and are not intended to limit the invention. Those of skill in the art will readily recognize a variety of non-critical parameters that can be changed or modified to yield essentially the same results.

EXAMPLES

Example 1. Identification of Antibody Variants Having Anti-Tumor Effects

An initial lead antibody sequence, designated as AIP-192482, was obtained by sequencing a plasmablast from a patient that had non-small cell lung cancer was identified in an in vivo tumor model screen in combination with anti-PD1 antibody therapy.

Figures 1A, 1B, 1C, 1D:
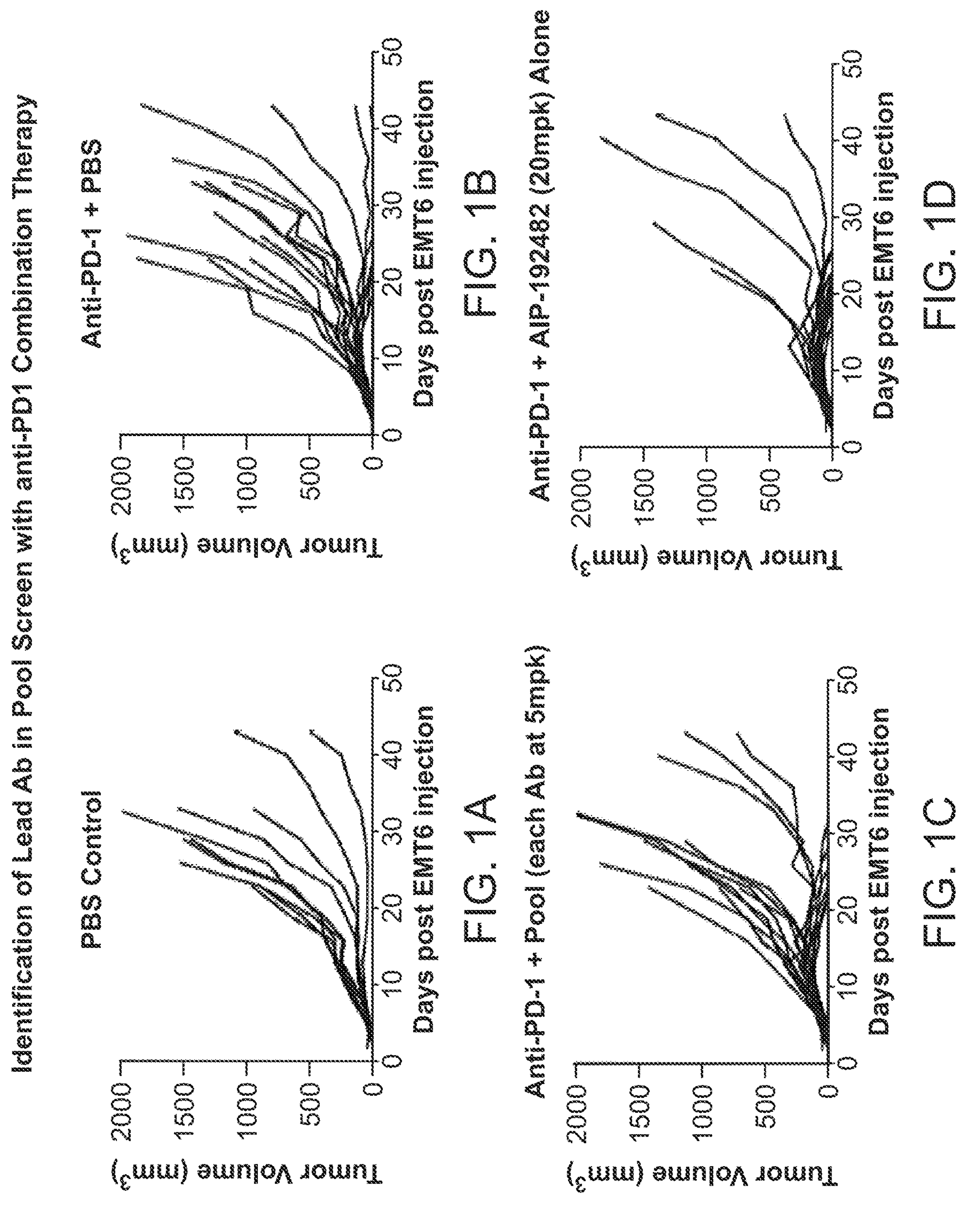
FIG. 1A-1D show tumor growth data from a screen of a pool of antibodies (4 antibodies, each obtained from a lung cancer patient) and lead antibody identified in the screen in combination with an anti-PD-1 antibody. Panel 1A, PBS control; Panel 1B, anti-PD1 antibody only; Panel 1C, anti-PD1 plus antibody pool; Panel 1D, combination of anti-PD1 antibody and AIP-192482 (lead antibody).

An EMT6 ectopic tumor model was employed in the initial screen. Balb/c mice were injected subcutaneously along the right flank with $10^6$ EMT6 cells. Anti-tumor activity of an initial antibody from the lineage was further evaluated in the EMT6 syngeneic ectopic breast cancer model in Balb/c mice. Mice were randomized into treatment groups based on tumor volume (TV) once tumors reached an average of 75-120 $mm^3$. Treatment with test antibodies and/or checkpoint inhibitor therapy started on the day of randomization. Unless otherwise stated, test antibodies were administered twice weekly for 3.5 weeks (TW×3.5 w) by intraperitoneal (i.p.) injection. Pools of four antibodies were tested at doses of 5 mg/kg (mpk) each (20 mg/kg total antibody) by i.p. injection twice weekly for 3.5 weeks (7 doses). Animals were treated in combination with anti-mouse PD1 antibody dosed i.p. at 10 mpk, twice weekly for two weeks. The initial lead antibody was also tested alone (outside of pool) at 20 mpk in combination with anti-PD1. The antibody pool containing the lead antibody showed anti-tumor activity (FIG. 1).

Figure 2A:
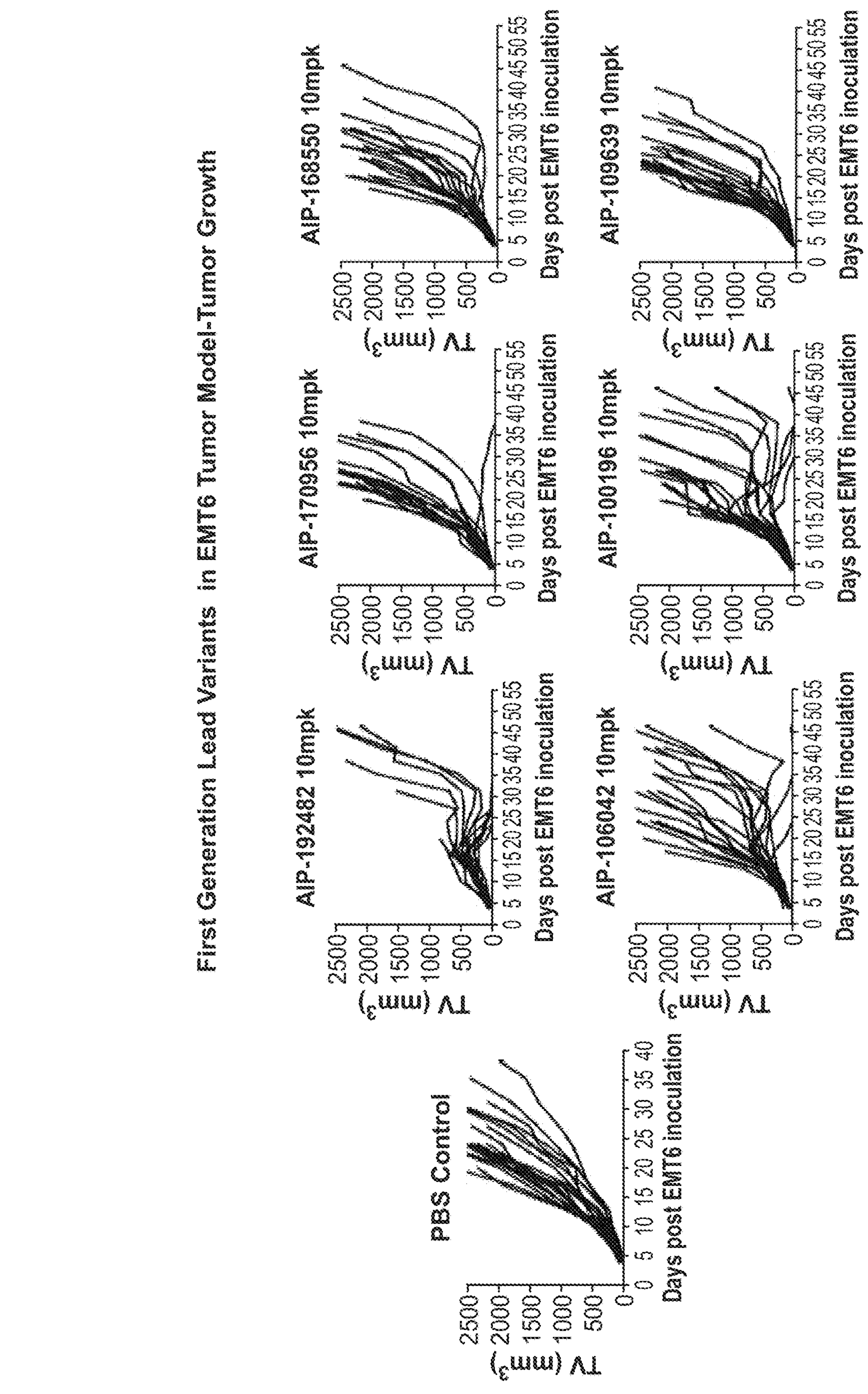
FIGS. 2A and 2B provide data showing the effects of administration of lead antibody and variants on tumor growth in the EMT6 mouse tumor model.
Figure 2B:
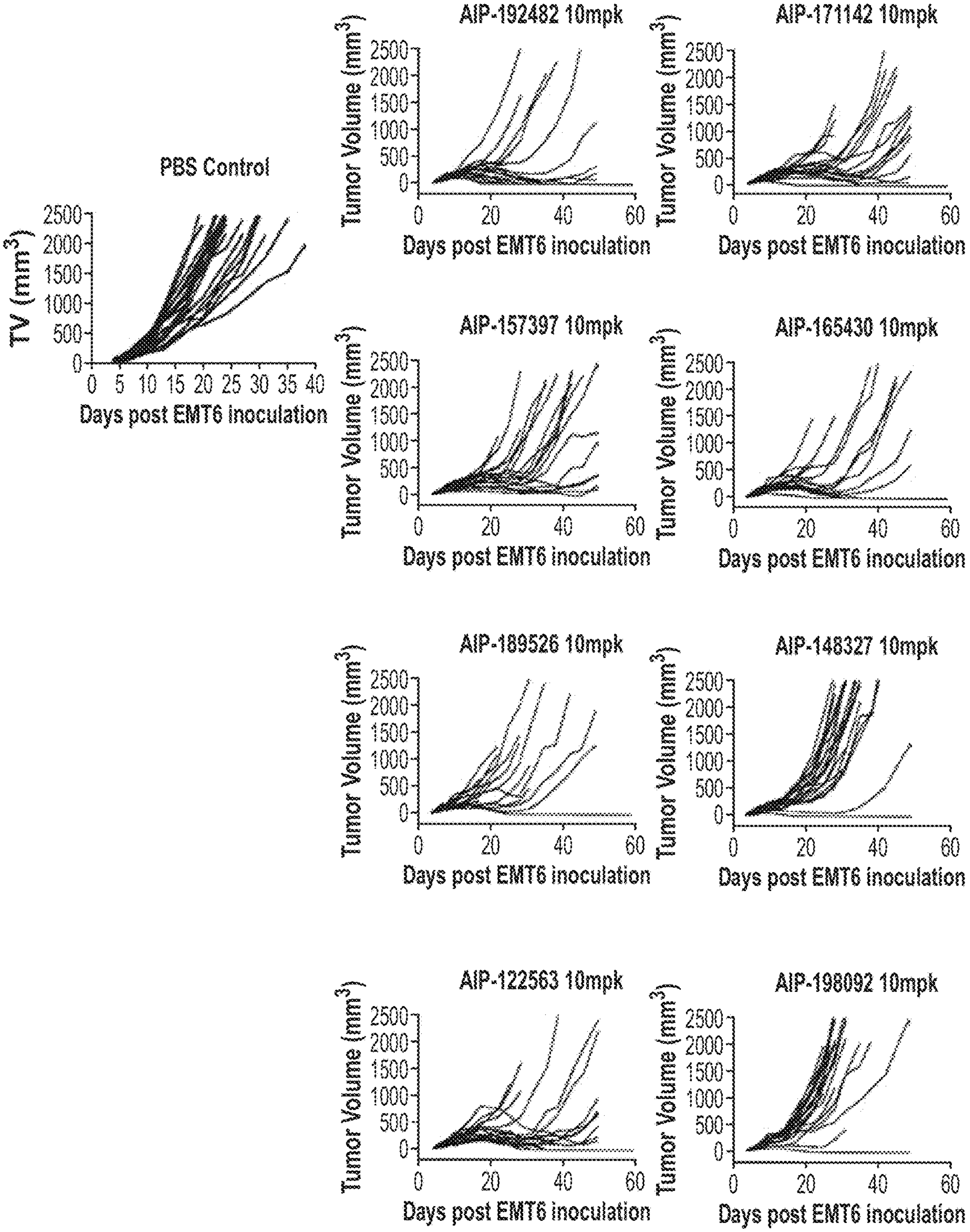

Variants of the initial lead antibody were generated and tested in the EMT6 tumor model (subcutaneous injection of tumor cells). Variants were tested as a monotherapy and administered at doses at 10 mpk twice weekly for 3.5 weeks as above. Variants having anti-tumor activity were identified (FIGS. 2A and 2B).

Figure 3A:
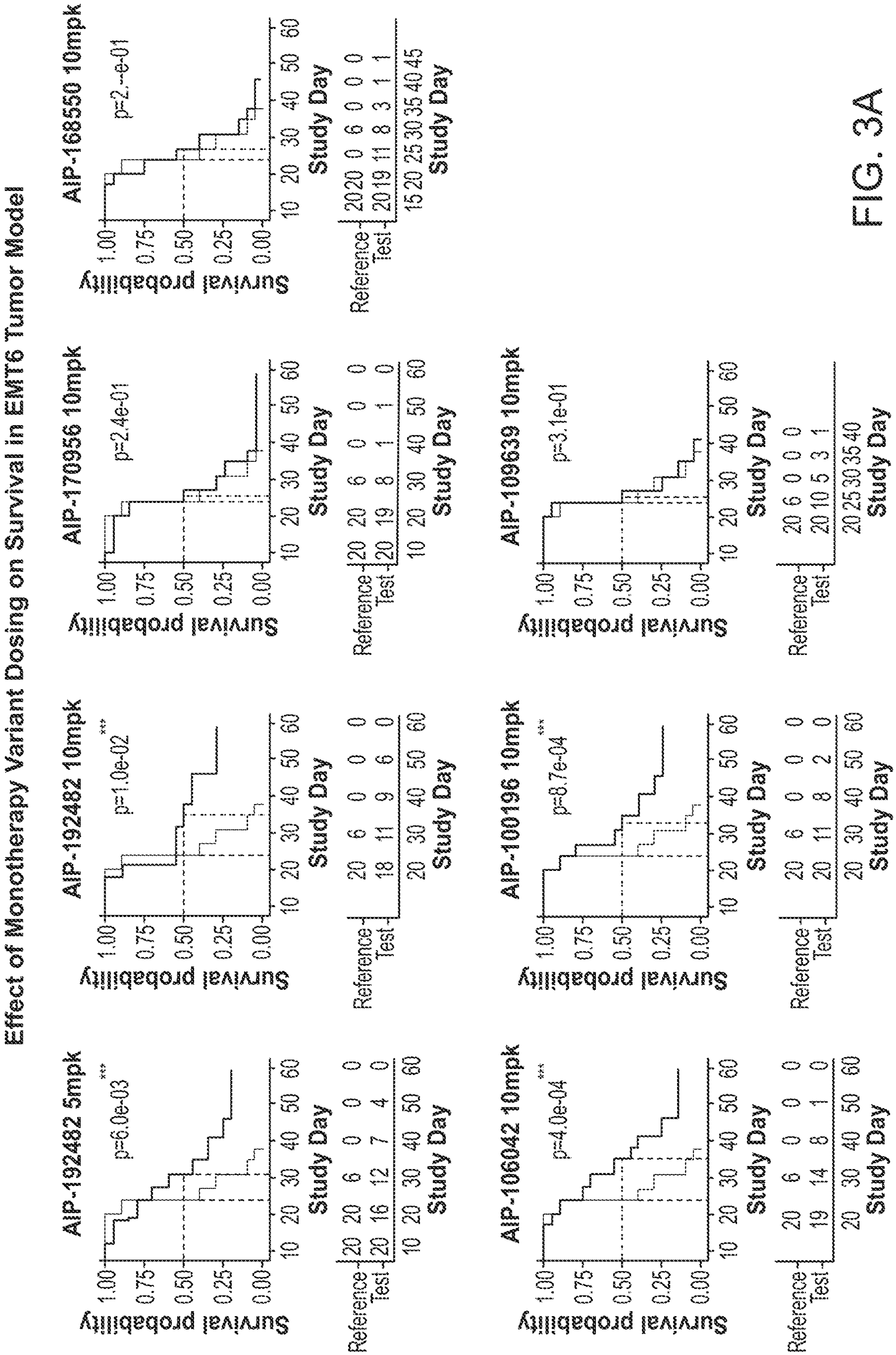
FIGS. 3A and 3B provide data showing the effects of administration of initial lead antibody and variants on survival in the EMT6 mouse tumor model.
Figure 3B:
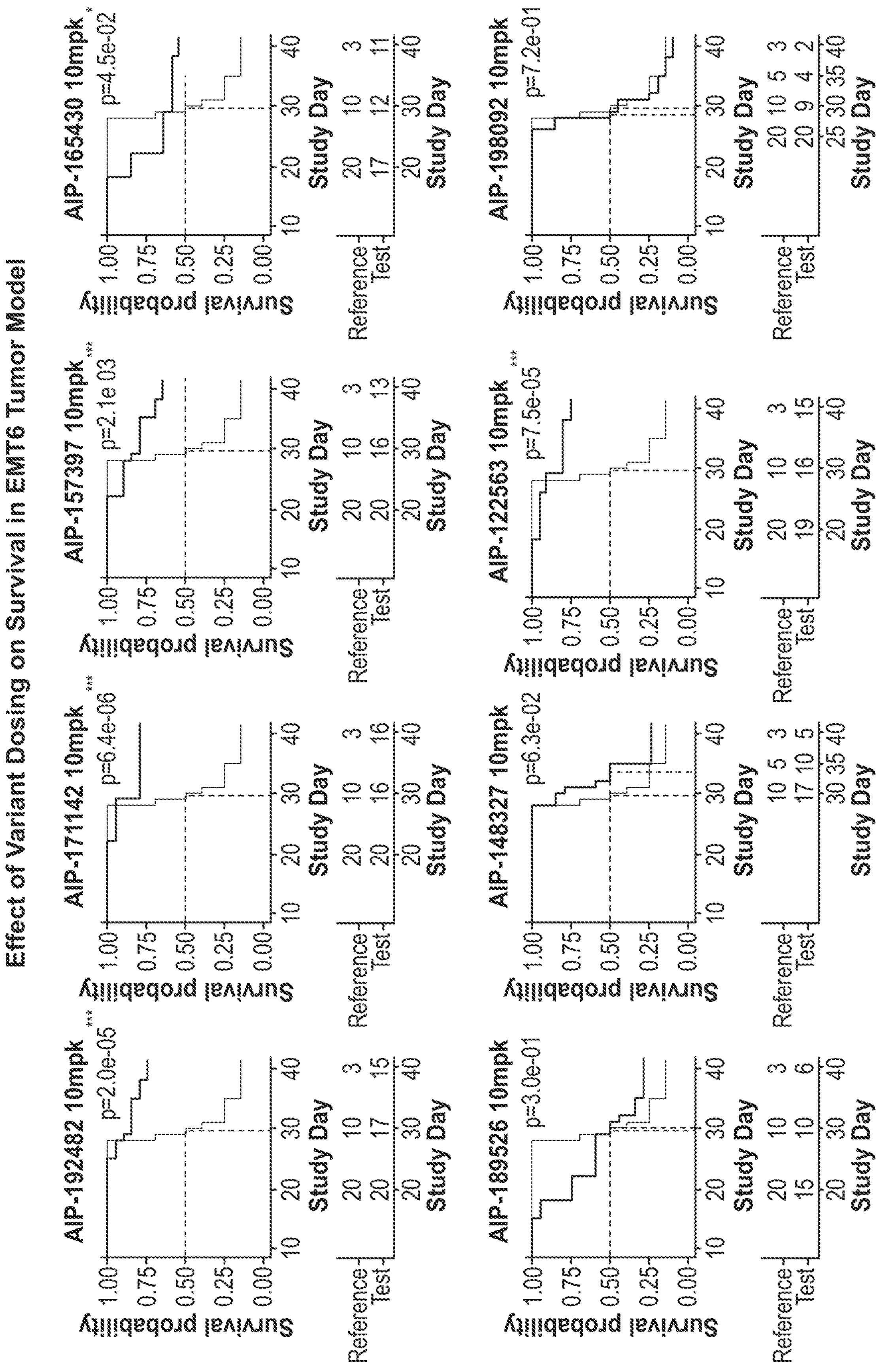

Survival probability data for the initial lead antibody and variants are shown in FIGS. 3A and 3B. P-values were calculated by log-rank test. The initial lead antibody showed marked effects on survival at doses of both 5 mpk and 10 mpk. Variants AIP-106042 and AIP-100196 (FIG. 3A) showed pronounced effects, as did variants AIP-122563, AIP-165430, AIP-157397, and AIP-171142 (FIG. 3B). Other variants also exhibited increased survival probability, although at lower levels (FIGS. 3A and 3B). For example, antibody AIP-148327 increased survival probability at day 40 compared to controls (FIG. 3B).

Figure 4A:
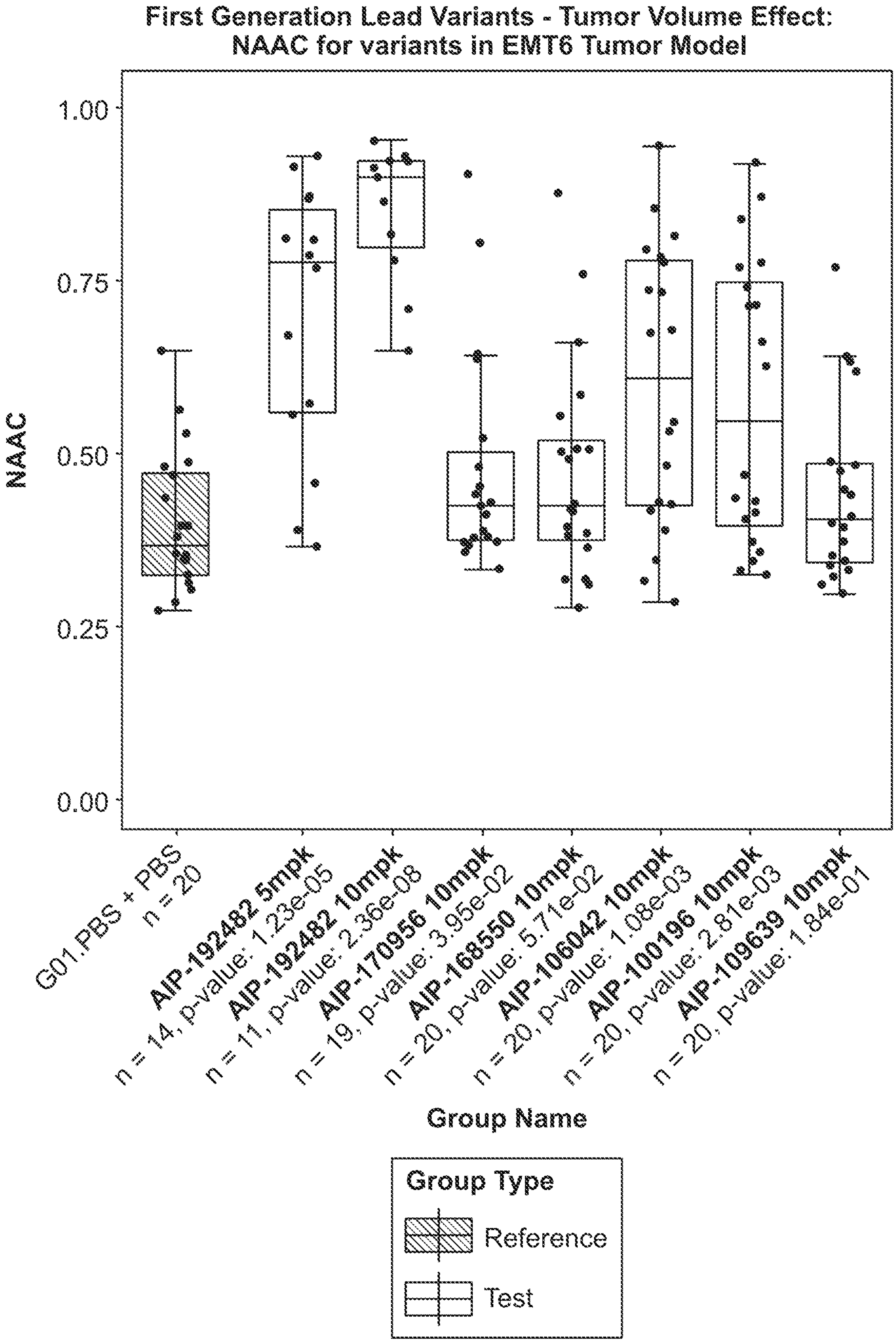
FIGS. 4A and 4B provide normalized area above the curve (NAAC) tumor volume data for lead antibody and variants in the EMT6 mouse tumor model.
Figure 4B:
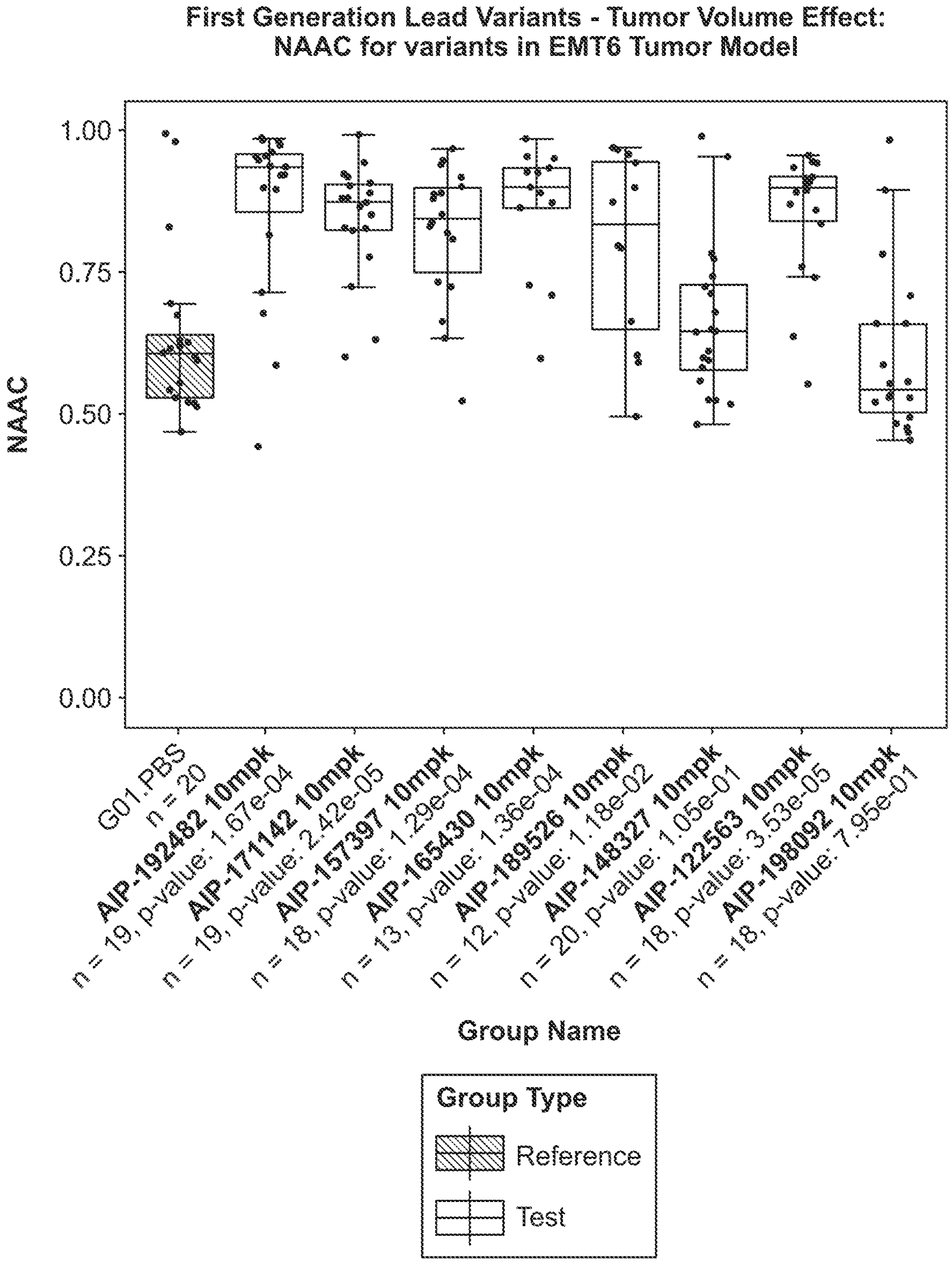
Figure 5A:
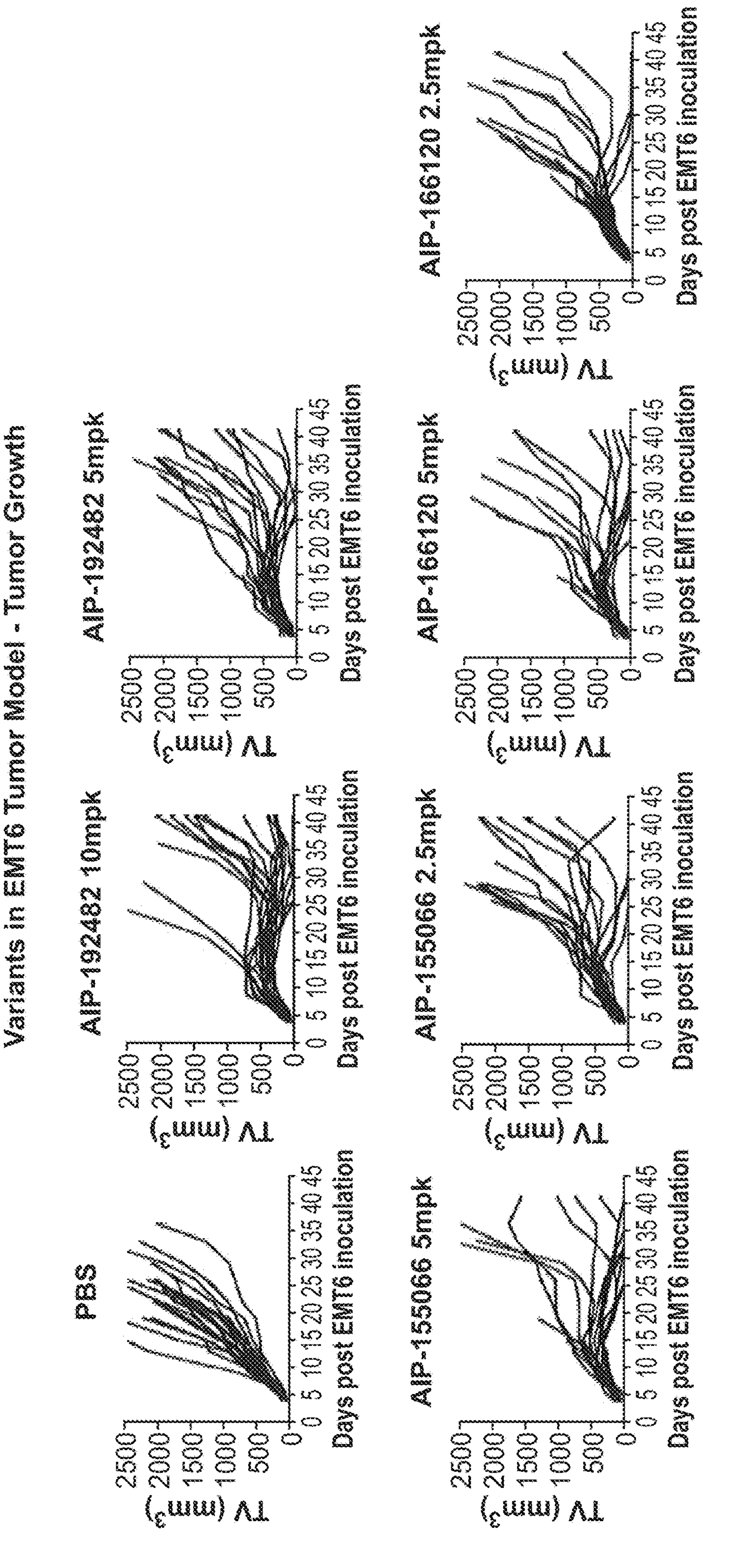
FIGS. 5A-5D provide data showing the effects of administration of lead antibody and variants on tumor growth in the EMT6 mouse tumor model.
Figure 5B:
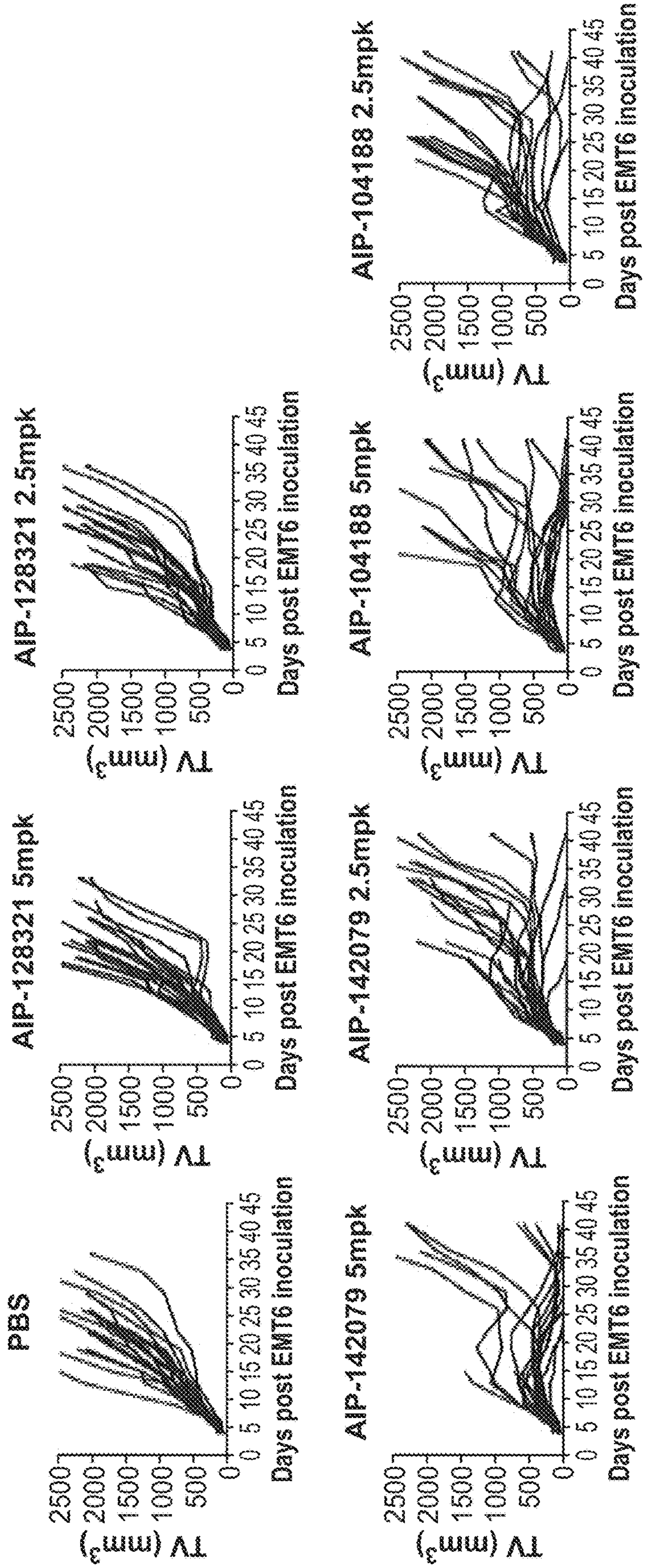
Figure 5C:
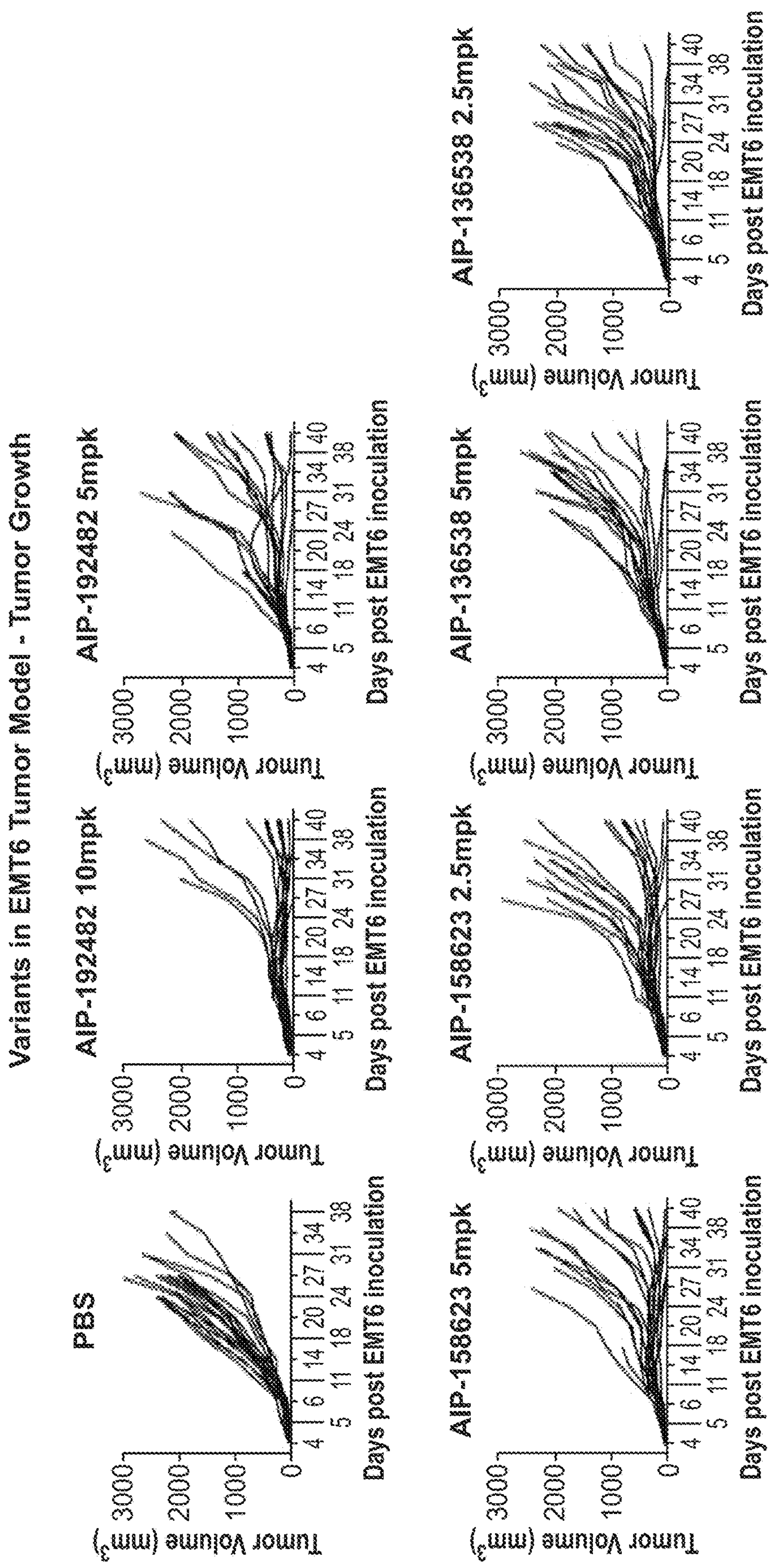
Figure 5D:
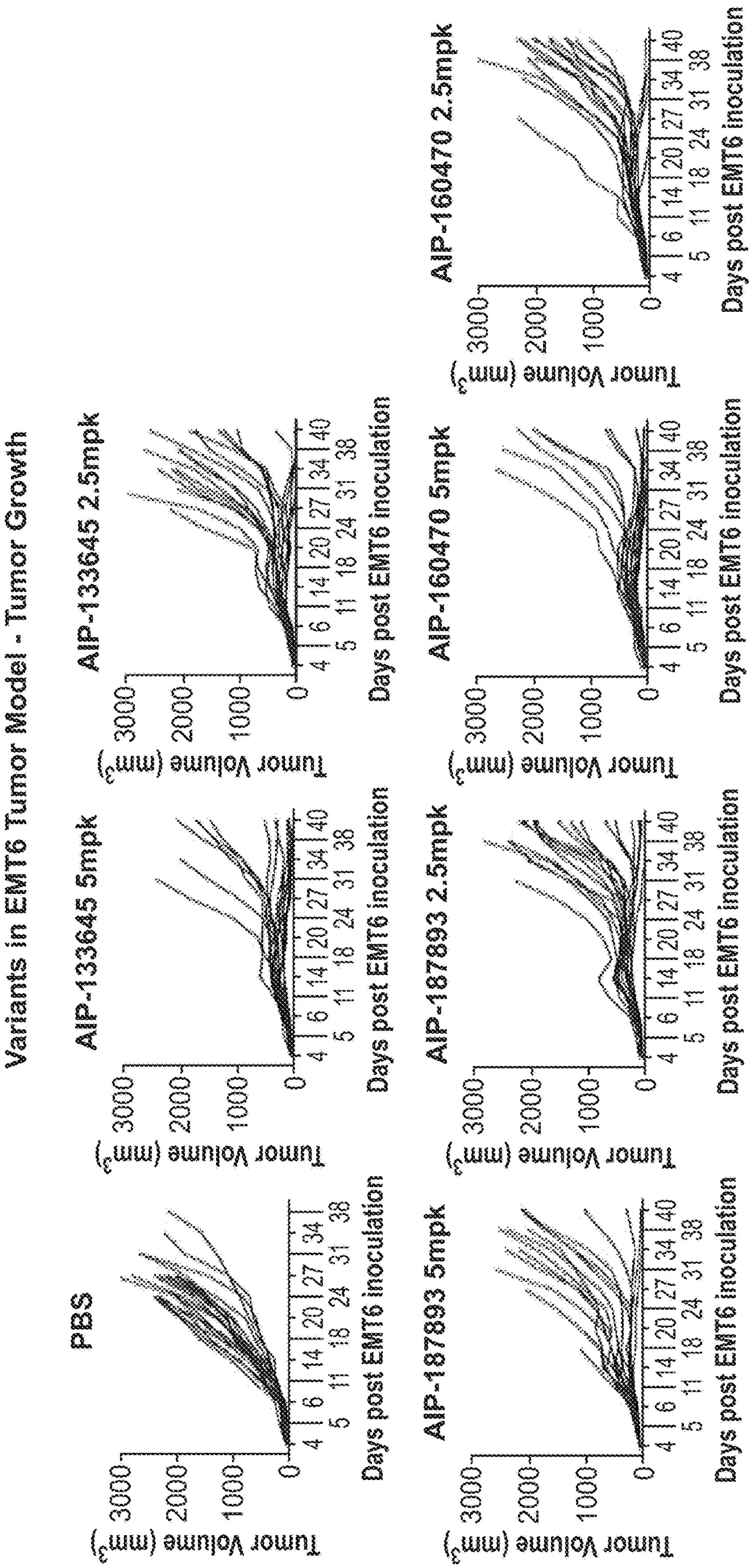

The effects of administration of variants on tumor volume are shown in FIGS. 4A and 4B. Data are expressed as Normalized Area Above the Curve (NAAC). A NAAC value is computed for each individual antibody based on its tumor volume curves. A NAAC value falls between 0 and 1. The closer the value is to 1, the lower the tumor volume is over time, i.e., the more efficacious is the treatment. Variants were identified that had pronounced effects on tumor volume e.g., AIP-106042 and AIP-100196 (FIG. 4A) and AIP-171142, AIP-157397, AIP-165430, and AIP-122563 (FIG. 4B). Treatment with other antibody variants also led to at least some reduction in tumor volume.

Variants of antibodies identified in the screen of first-generation variants as having anti-tumor activity were also generated. These variants were also evaluated as a monotherapy in the EMT6 tumor model as described above.

Variants were administered the doses indicated in FIGS. 5A-5D twice weeks for 3.5 weeks. Variants having anti-tumor effects were identified (FIGS. 5A-5D).

Figure 6A:
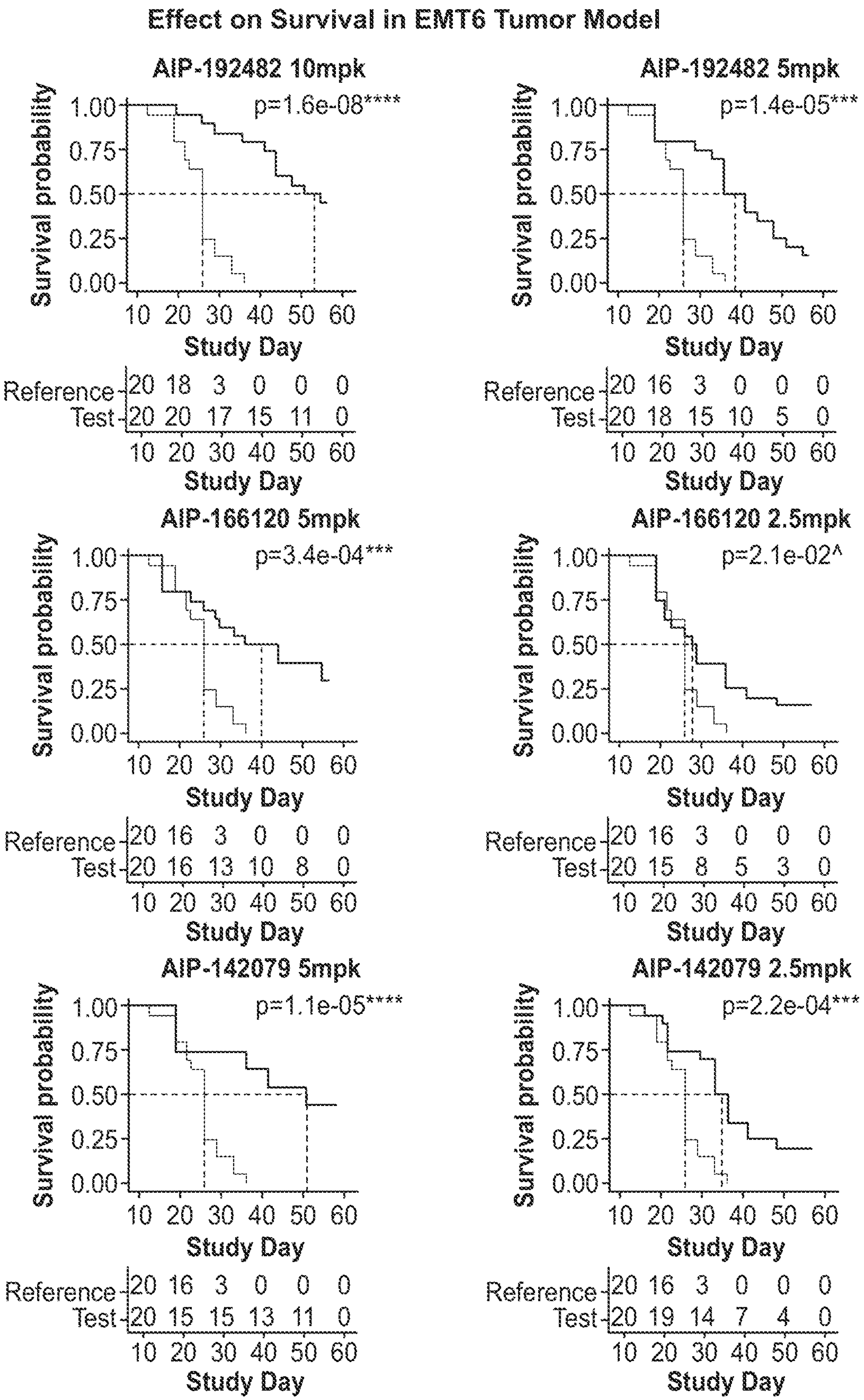
FIGS. 6A, 6AA, 6B and 6BB show survival data in the EMT6 tumor model comparing lead antibody and variants to control.
Figure 6A:
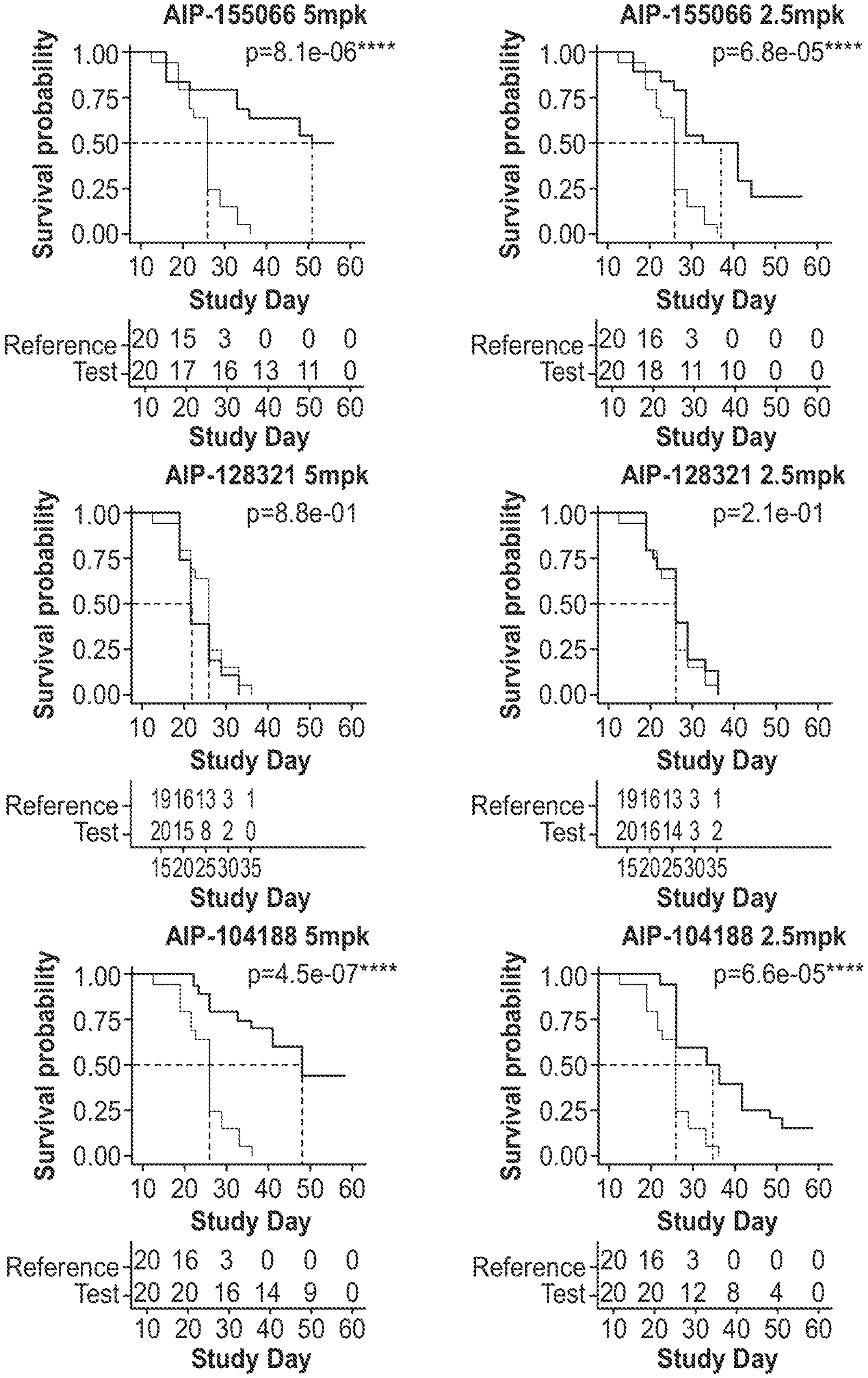
Figure 6B:
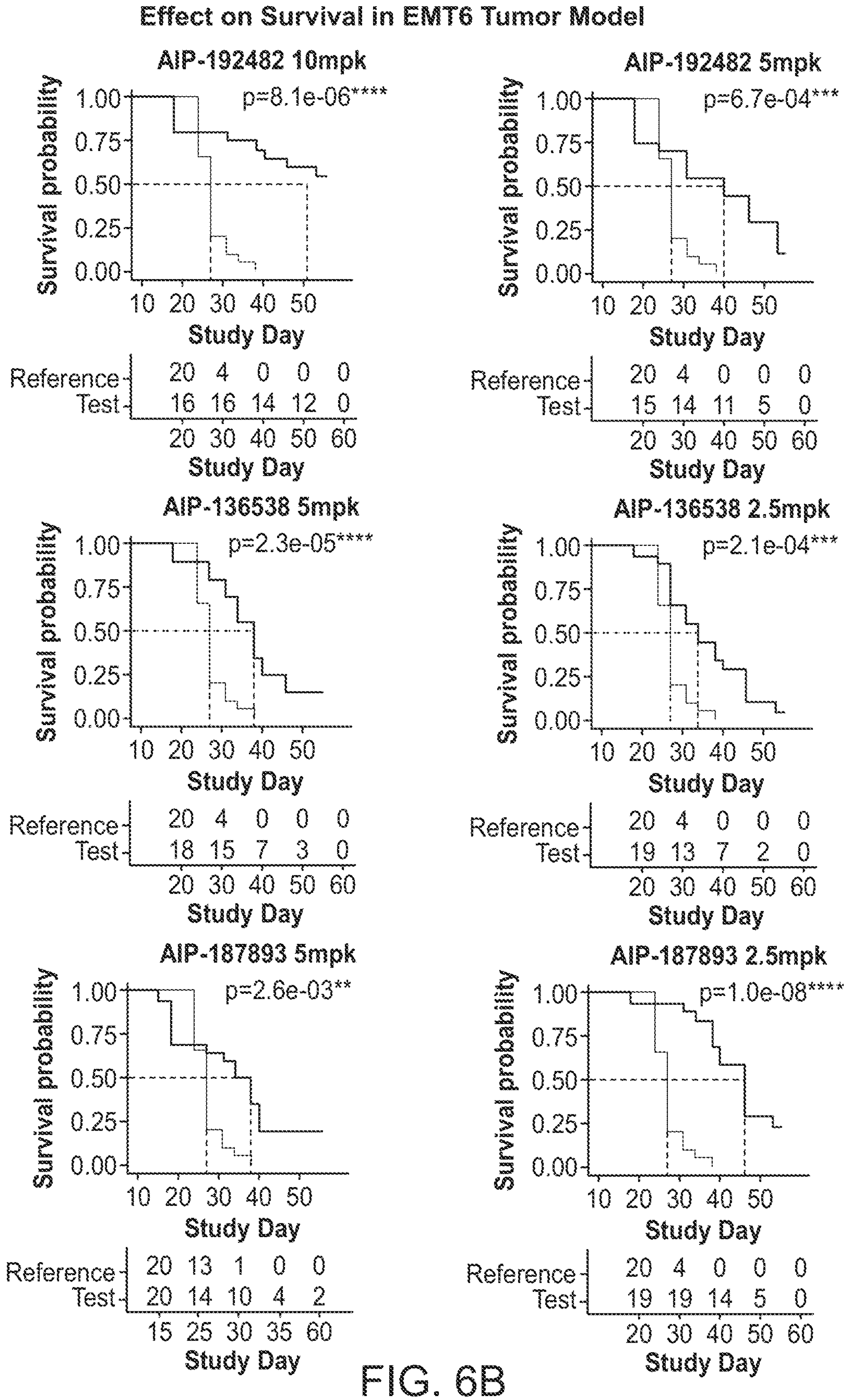
Figure 6B:
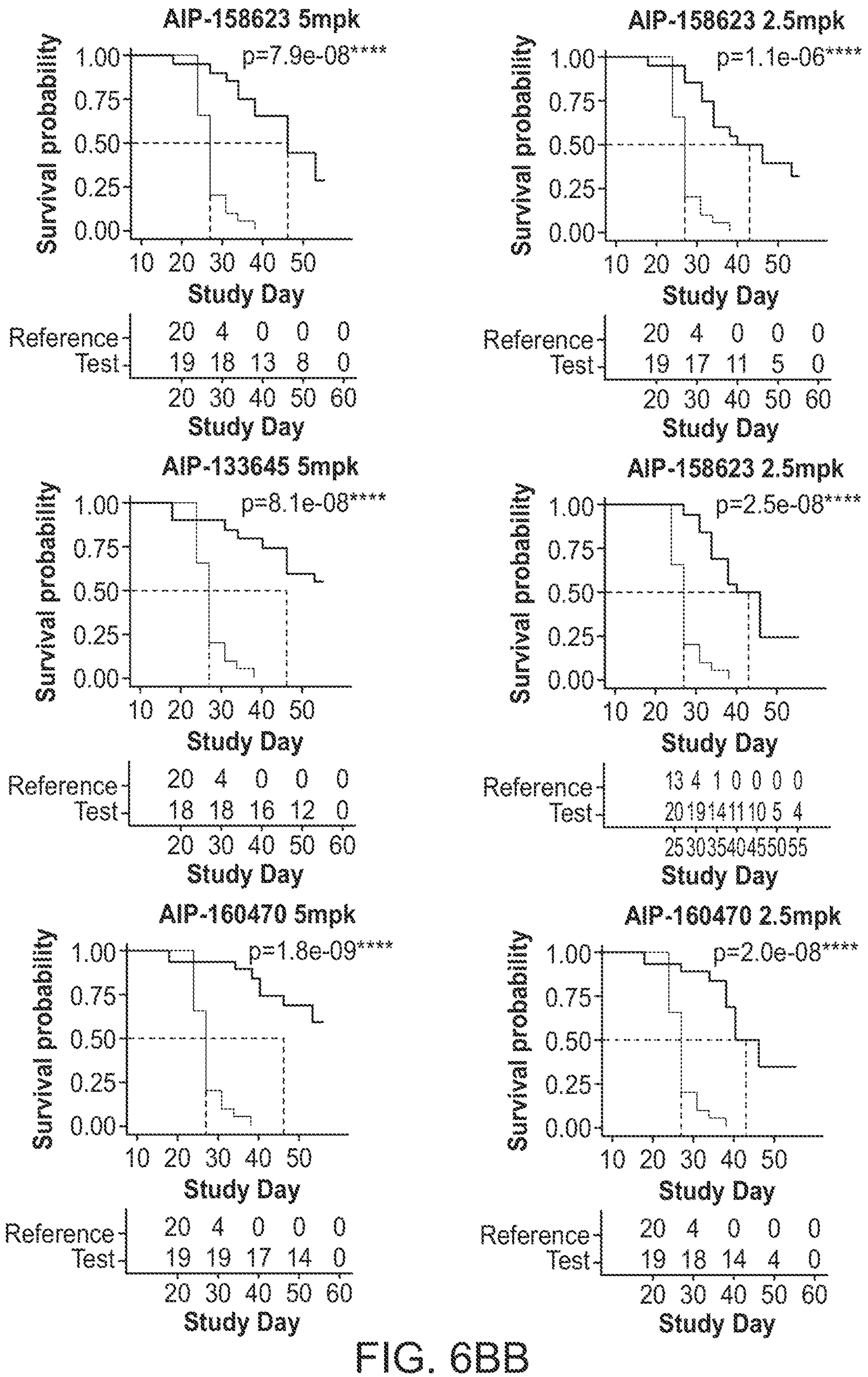

Survival data for antibodies treated with the second-generation variants are shown in FIGS. 6A and 6B. P-values were calculated by log-rank test. Variants were identified that showed pronounced increased in survival probability (e.g., AIP-155066, AIP-166120, AIP-142079, AIP-104188 (FIG. 6A) and AIP-158623, AIP-133645, AIP-136538, AIP-187893, and AIP-160470 (FIG. 6B).

Figure 7A:
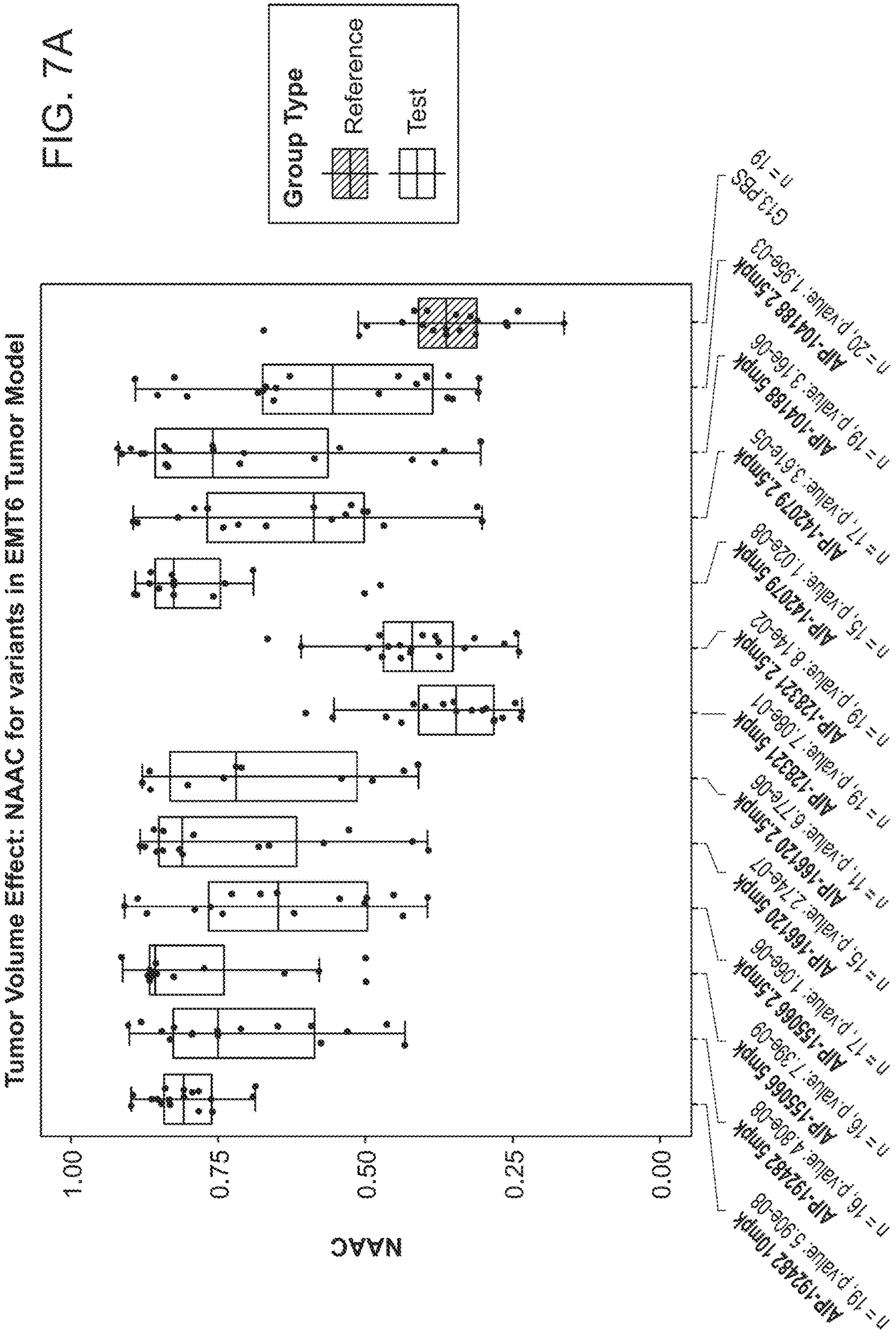
FIGS. 7A-7B provide NAAC data obtained for initial lead antibody and variants tested in the EMT6 mouse tumor model.
Figure 7B:
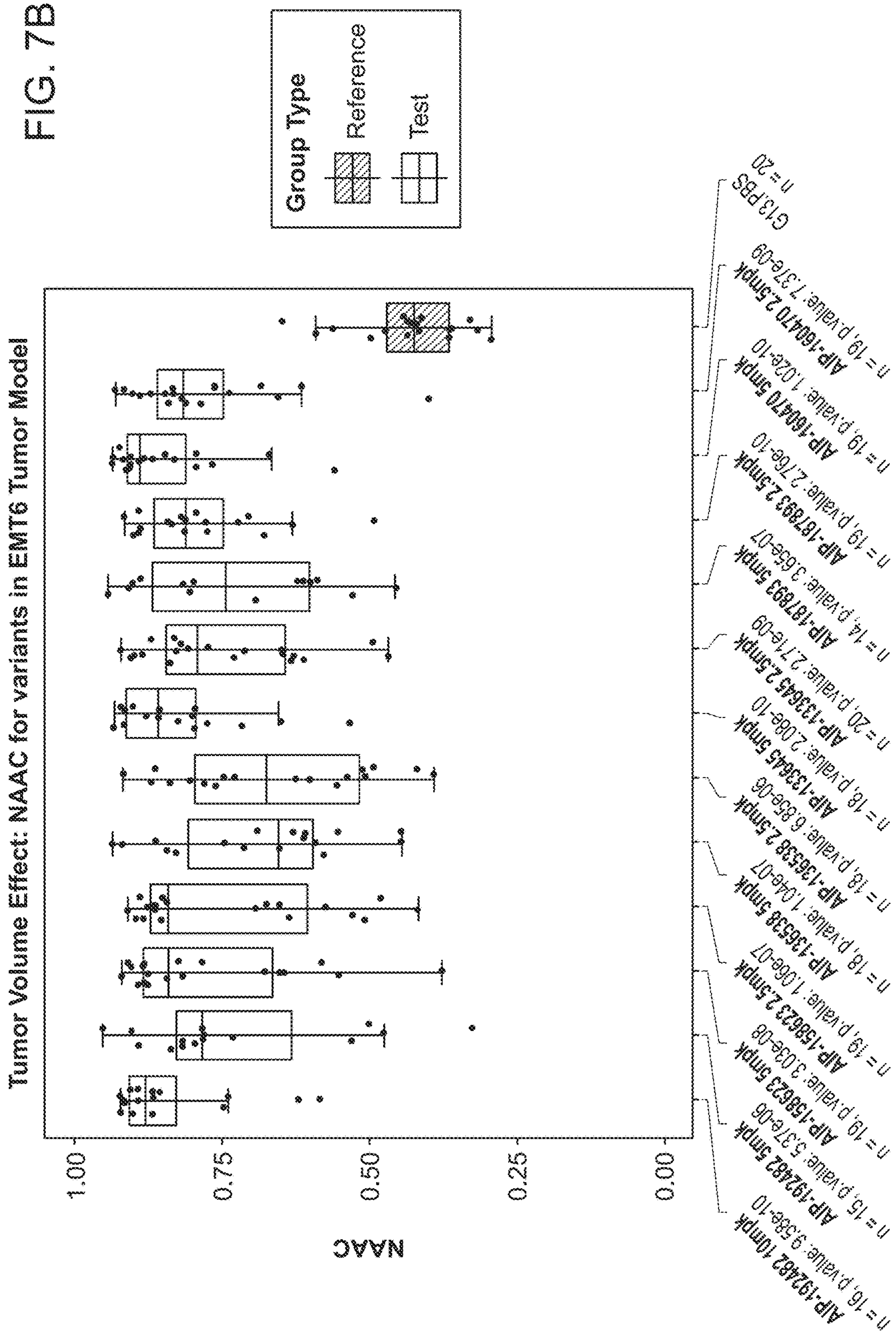

The effects of administration of second-generation variants on tumor volume in the EMT6 tumor model are shown in FIGS. 7A and 7B. Variants AIP-155066, AIP-166120, AIP-142079, and AIP-104188 exhibited NAAC values significantly above control when administered in an amount of 5 mpk with most also showing NAAC values significantly above control at 2.5 mpk. Variants AIP-158623, AIP-136538, AIP-133645, and AIP-187893 exhibited pronounced NAAC values for all concentrations tested; with some variants showing NAAC values well-above control.

Figure 9:
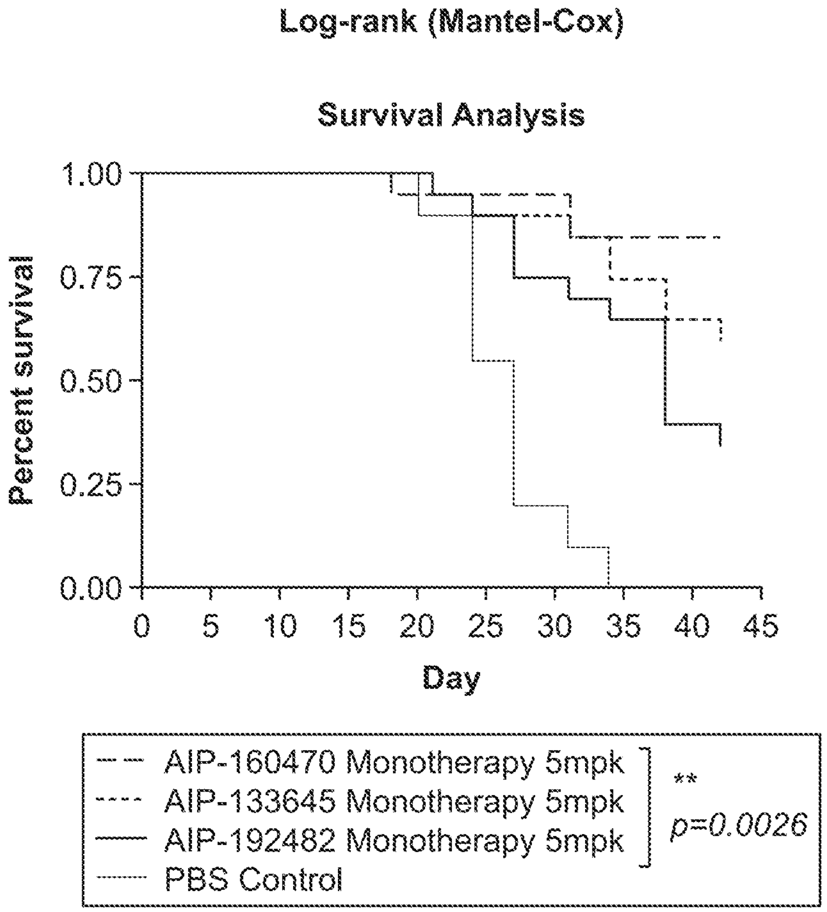
FIG. 9 shows monotherapy survival data for the initial lead antibody and two variants tested in the study summarized in FIG. 8.
Figure 10:
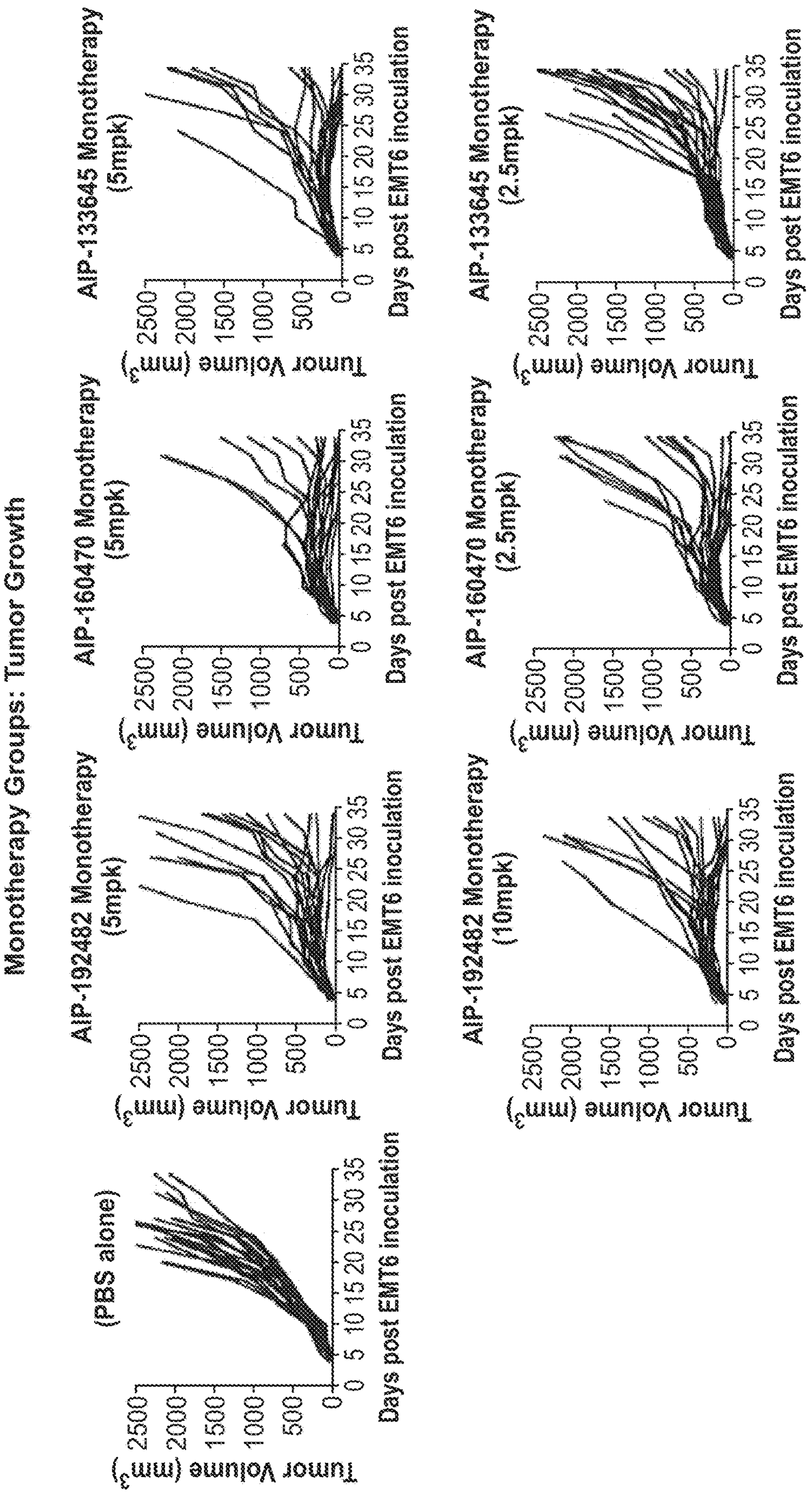
FIG. 10 provides monotherapy tumor growth data for the initial lead antibody and two variants tested in the study summarized in FIG. 8.
Figure 11:
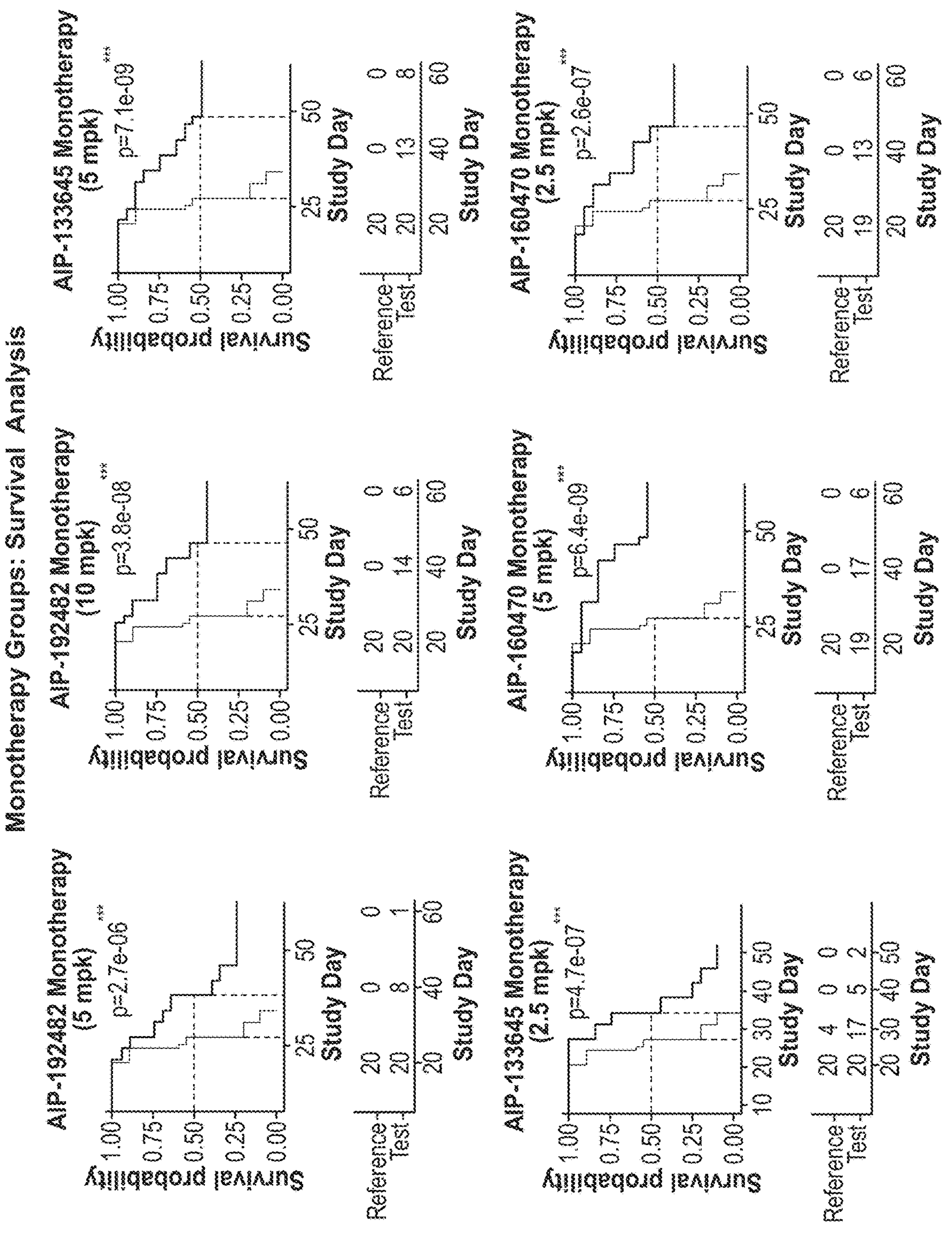
FIG. 11 provides monotherapy survival probability data for the initial lead antibody and two variants tested in the study summarized in FIG. 8.
Figure 12:
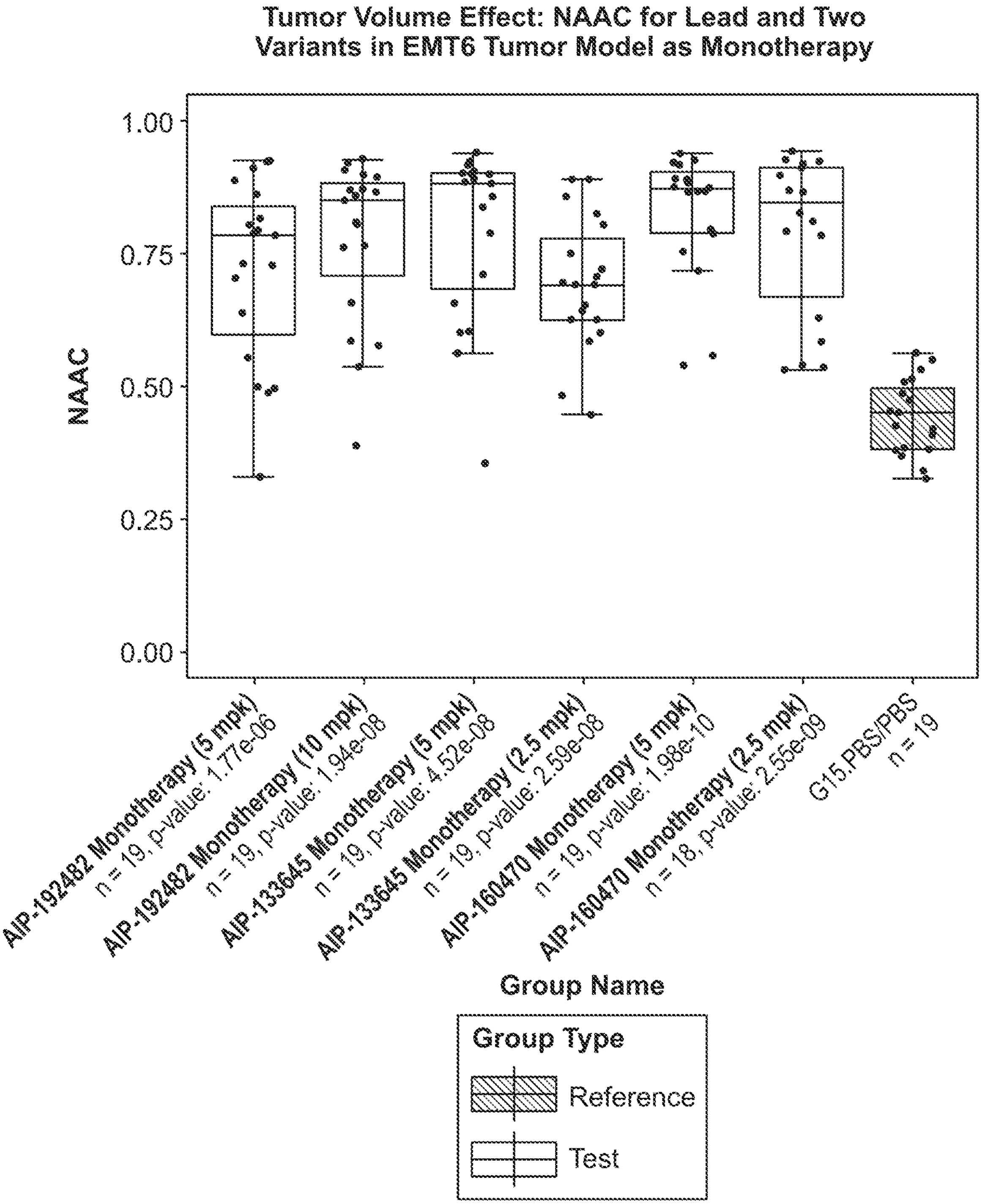
FIG. 12 provides monotherapy tumor volume data for the initial lead antibody and two variants tested in the study summarized in FIG. 8.
Figure 13:
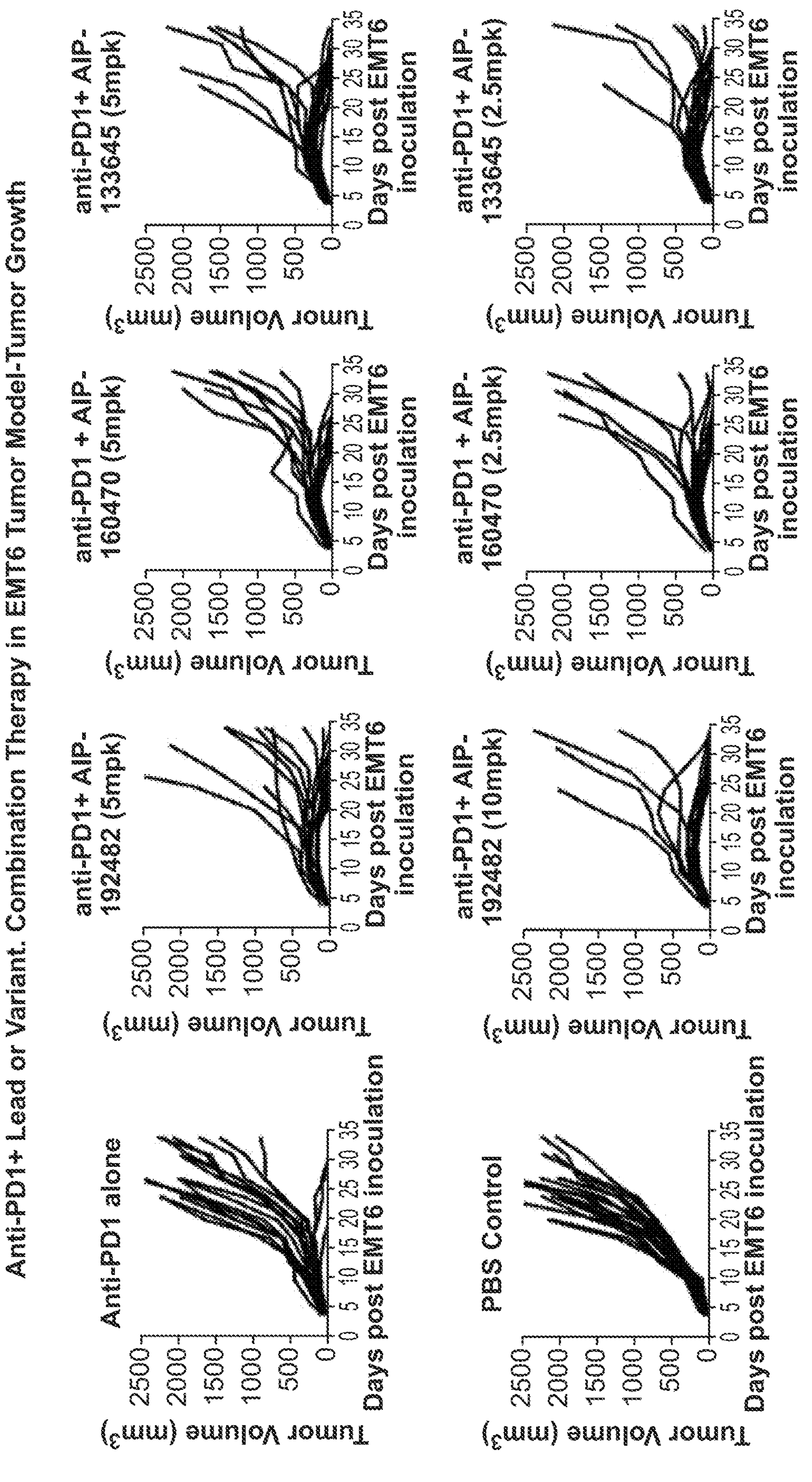
FIG. 13 provides combination therapy tumor growth data for the initial lead antibody and two variants tested in combination with an anti-PD1 antibody in the study summarized in FIG. 8.
Figure 14:
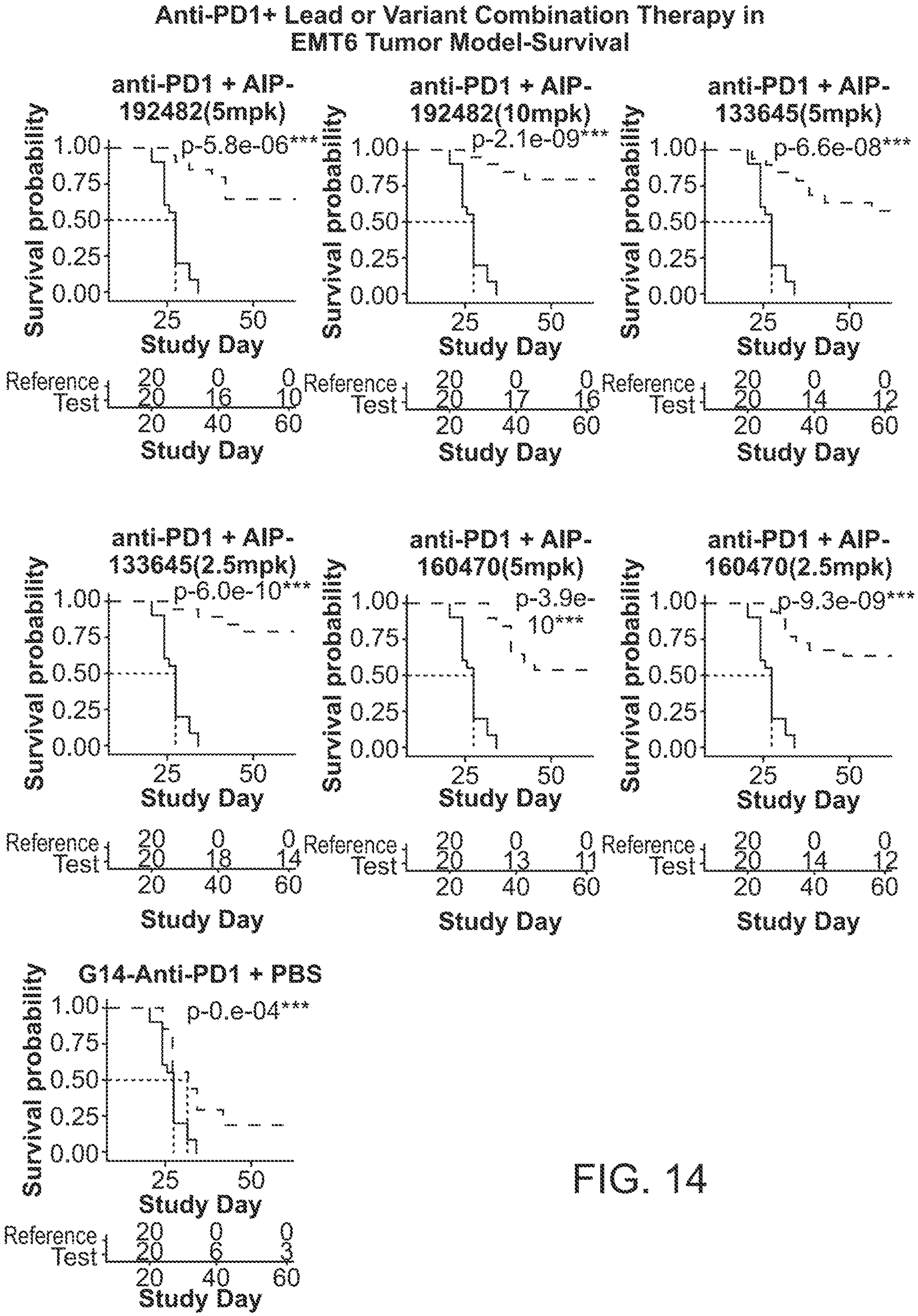
FIG. 14 provides combination therapy survival probability data for the initial lead antibody and two variants tested in combination with an anti-PD1 antibody in the study summarized in FIG. 8.
Figure 15:
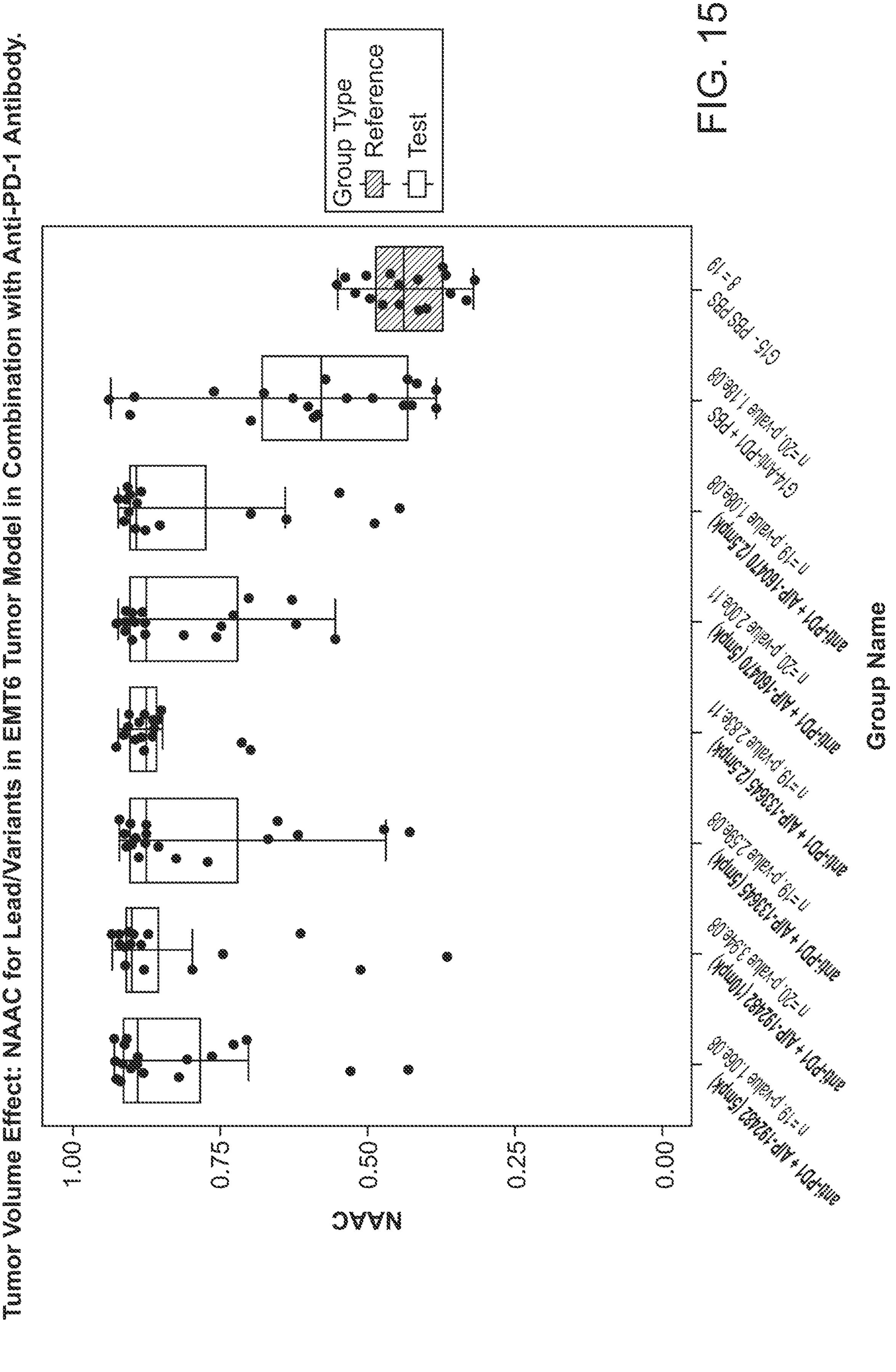
FIG. 15 provides combination therapy tumor volume data for the initial lead antibody and two variants tested in combination with an anti-PD1 antibody in the study summarized in FIG. 8.

Treatment with two of the variants (AIP-133645 and AIP-160470) identified in the preceding analysis was evaluated when administered in combination with anti-PD1 antibody. The EMT6 tumor model was again used. The initial lead antibody was administered at doses of 5 and 10 mpk. Variants were dosed at 2.5 and 5 mpk. The anti-PD1 antibody was administered at 10 mpk. The study design is shown in FIG. 8. Antibodies were administered by i.p. injection at the indicated doses and frequencies. Survival analysis of the initial lead antibody and two variants when administered as a monotherapy is shown in FIG. 9. Both variants AIP-160470 and AIP-133645 were able to improve survival relative to the initial lead antibody Effects on tumor growth, survival probability, and tumor volume for the lead antibody and two variants when administered as monotherapies are shown in FIG. 10, FIG. 11, and FIG. 12, respectively. Effects on tumor growth, survival probability and tumor volume when the antibodies were administered in combination with the anti-PD1 antibody are shown in FIG. 13, FIG. 14, and FIG. 15, respectively.

Figure 16:
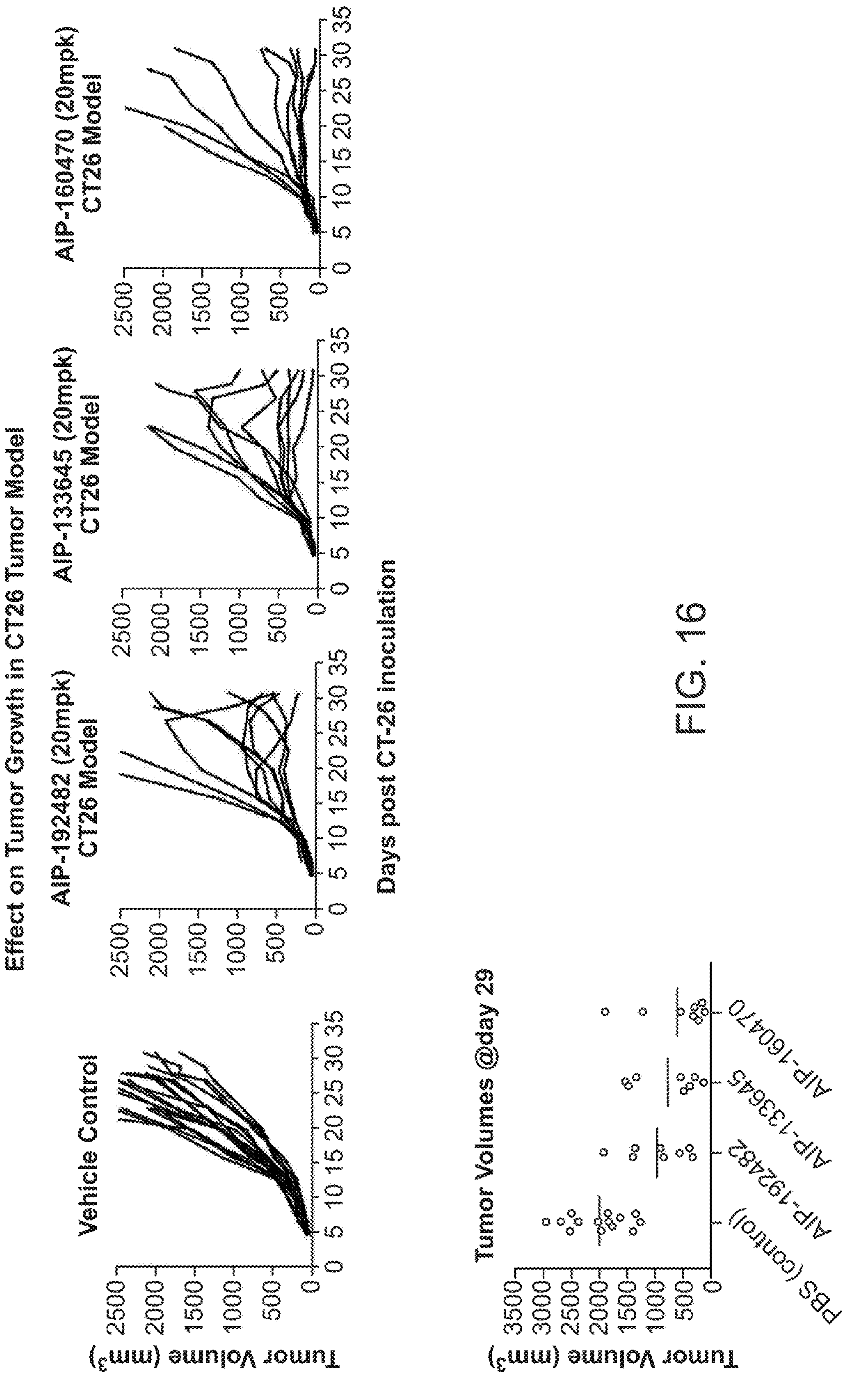
FIG. 16 provides tumor growth data for the initial lead antibody and two variants in the CT26 mouse model.
Figure 17:
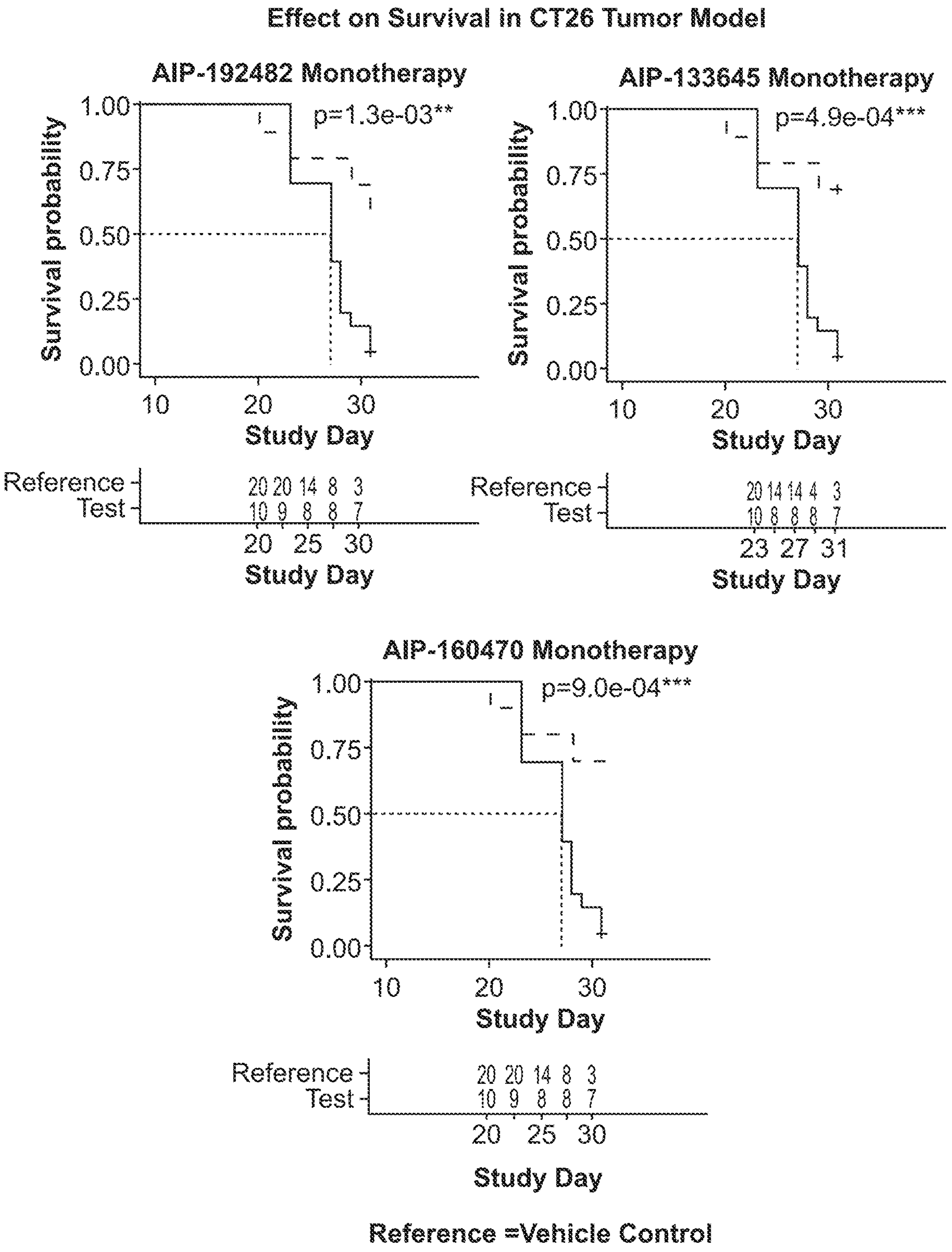
FIG. 17 provides survival probability data for the initial lead antibody and two variants tested in the CT26 mouse model.
Figure 18:
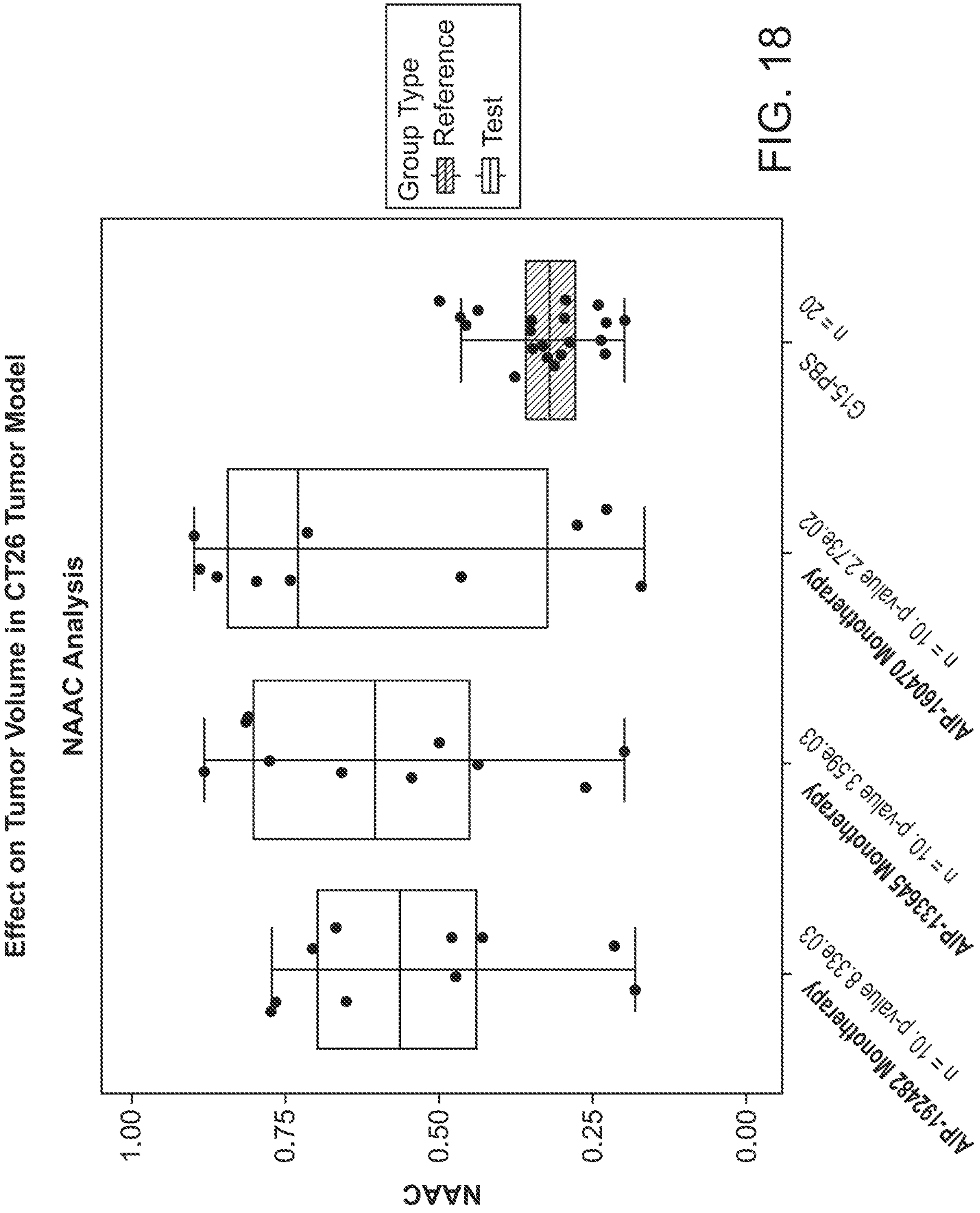
FIG. 18 provides tumor volume data for the initial lead antibody and two variants tested in the CT26 mouse model.

Anti-tumor effects of the initial lead antibody and variants AIP-160470 and AIP-133645 were also evaluated as monotherapies in a CT-26 colorectal cancer ectopic syngeneic mouse tumor model. Animals were injected subcutaneously with $10^6$ CT26 tumor cells along the right flank. Antibodies were administered at a dose of 20 mpk by i.p. injection 2×/wk for 3.5 weeks. Effects on tumor growth, survival probability, and tumor volume are shown in FIG. 16, FIG. 17, and FIG. 18, respectively. All three antibodies exhibited pronounced therapeutic effects in decreasing tumor growth, improving survival probability, decreasing tumor volume.

Example 2. Histological Analysis of Antibody Binding

Figure 19:
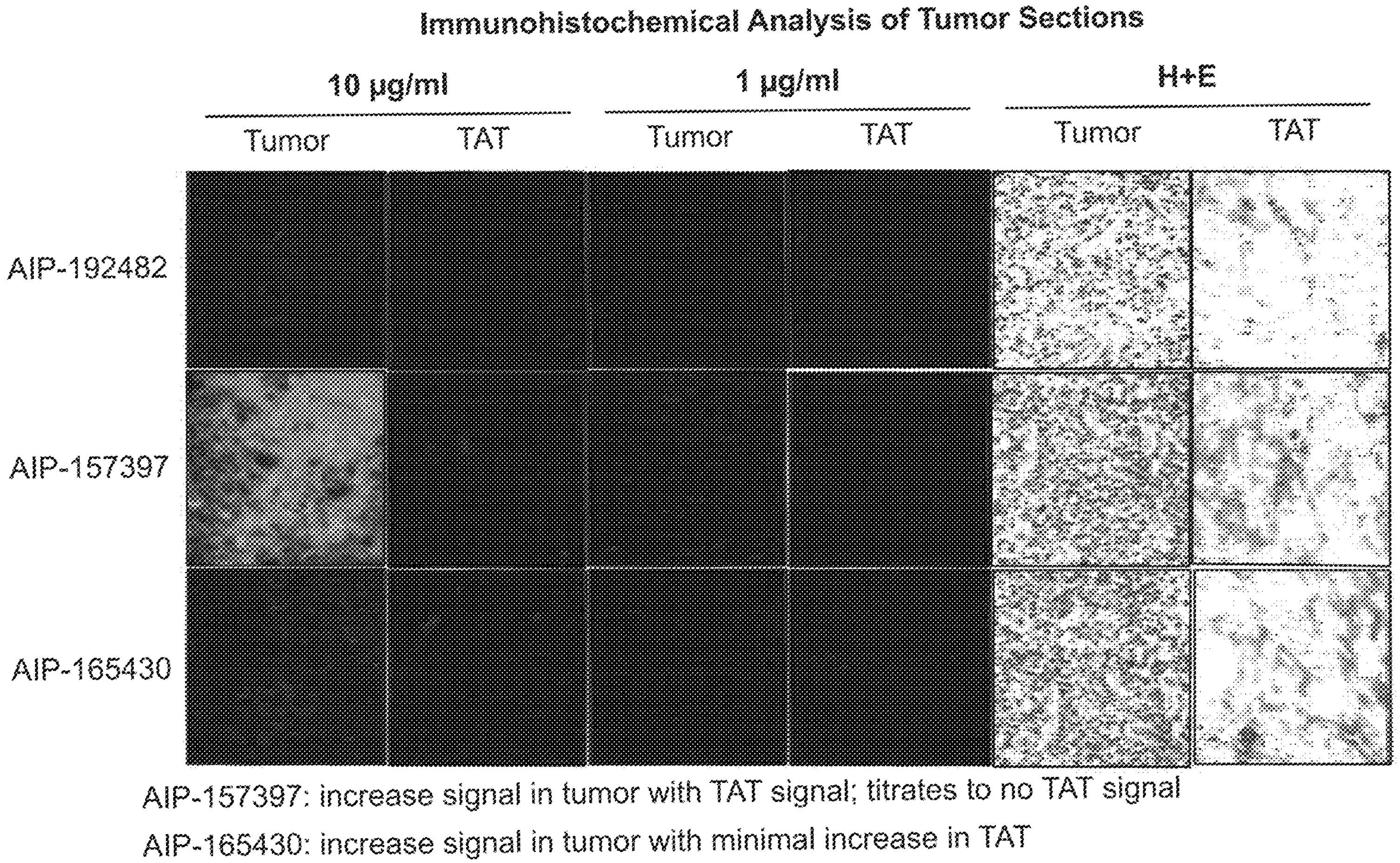
FIG. 19 provides immunohistochemical binding data showing binding of variant antibodies AIP-157397 and AIP-165430 to tumor and tumor adjacent tissue (TAT).

Binding to mouse and human tumor cells and adjacent tissues was also analyzed. The initial lead antibody and a subset of variants were tested for binding to human estrogen receptor (ER)-positive breast carcinoma (Stage II) and adjacent breast tissue. Frozen samples were cryosectioned, mounted on slides and lightly fixed with 4% PFA. Slides were incubated using 10, 1 and 0.3 μg/ml primary antibody and IgG control (no signal detected), followed by an anti-mouse secondary antibody conjugated to Cγ5, counterstained with Hoechst, and coverslipped in an aqueous mounting medium. Adjacent slides were stained with hematoxylin and eosin (H&E). FIG. 19 compares binding of the initial lead antibody to tumor and TAT to that of variants AIP-157397 and AIP-165430. Variant AIP-157397 exhibited a pronounced increase in signal for binding to tumor. Signal for binding to TAT also increased compared to the initial lead, but binding could be titrated such that no signal was observed in TAT. Variant AIP-165430 exhibited enhanced binding to tumor compared to the lead with minimal increased inbinding to TAT. Isotype controls showed no signal (data no shown).

Figure 20:
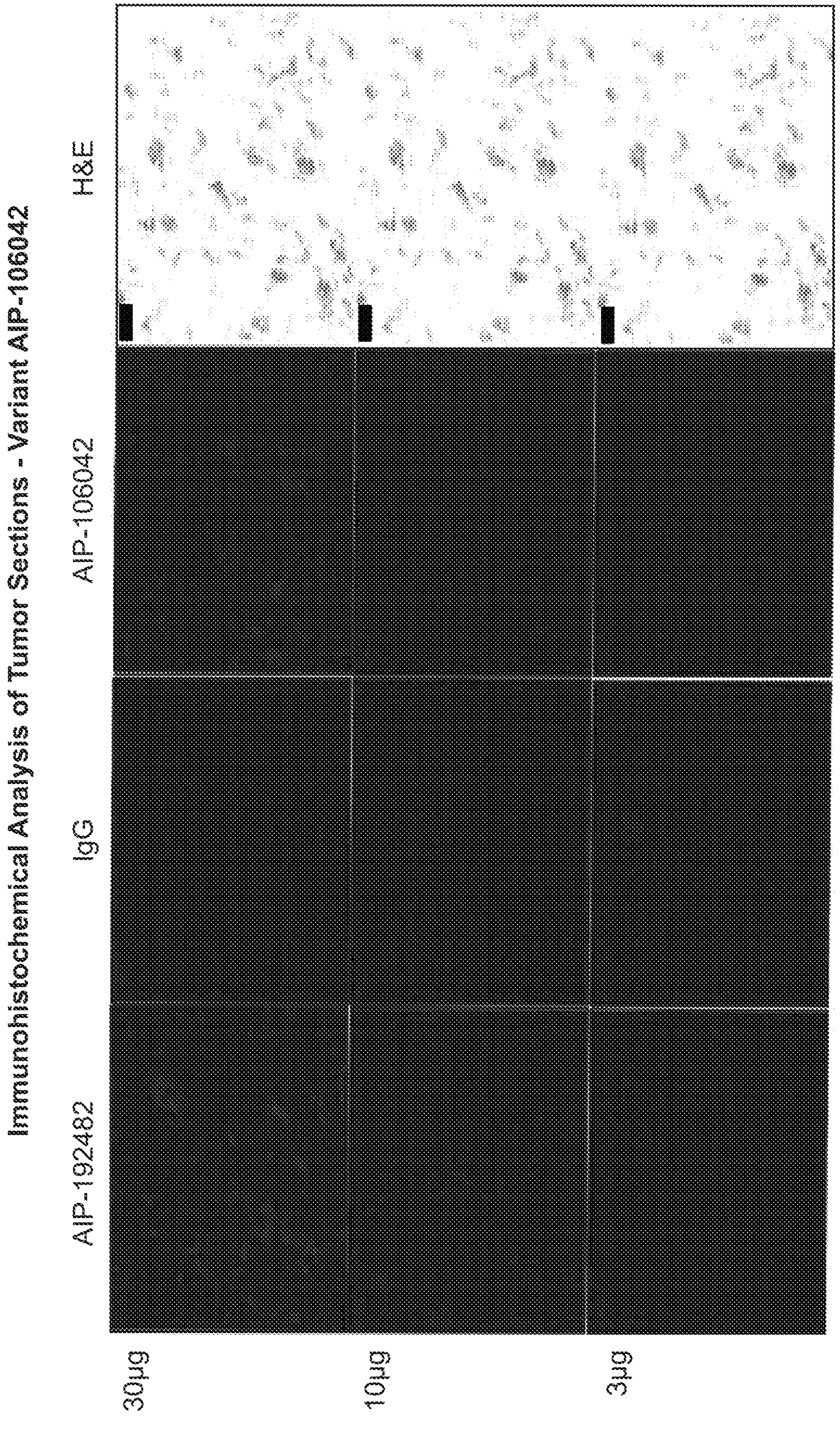
FIG. 20 provides immunohistochemical binding data showing binding of variant AIP-106042 to tumor tissue.
Figure 21:
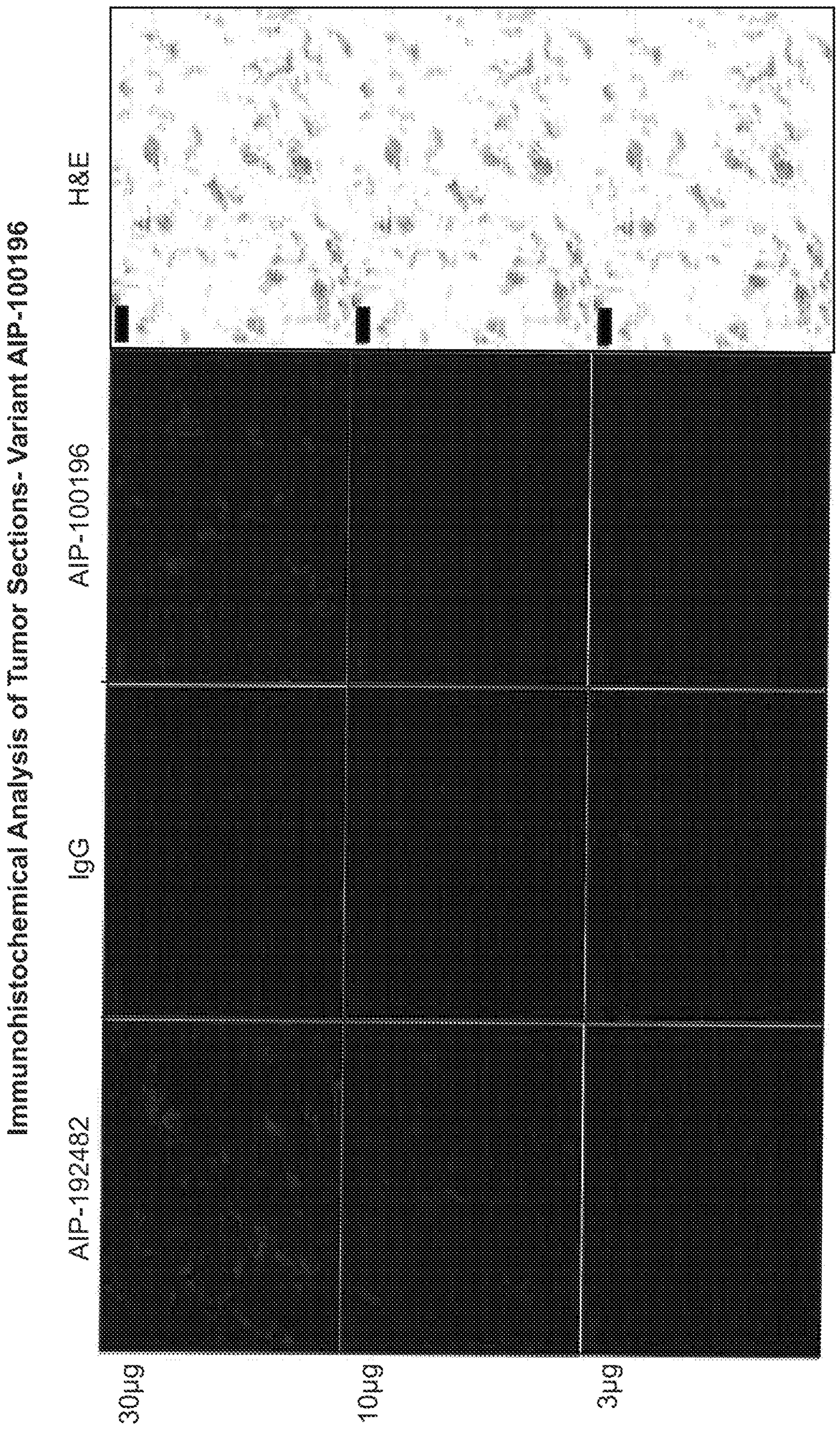
FIG. 21 provides immunohistochemical binding data showing binding of variant AIP-100196 to tumor tissue.

Binding of variants AIP-106042 and AIP-100196 to human ER-positive breast cancer tissue and TAT was also evaluated using slides prepared as described and stained using 30, 10 and 3 μg/ml primary antibody and IgG control. Adjacent sections were stained using H&E. Both variants AIP-106042 and AIP-100196 bound to tumor tissue, but at decreased levels when compared to the lead (FIGS. 20 and 21). Little to no binding to TAT was observed even at the highest concentrations tested (data not shown).

Figure 22:
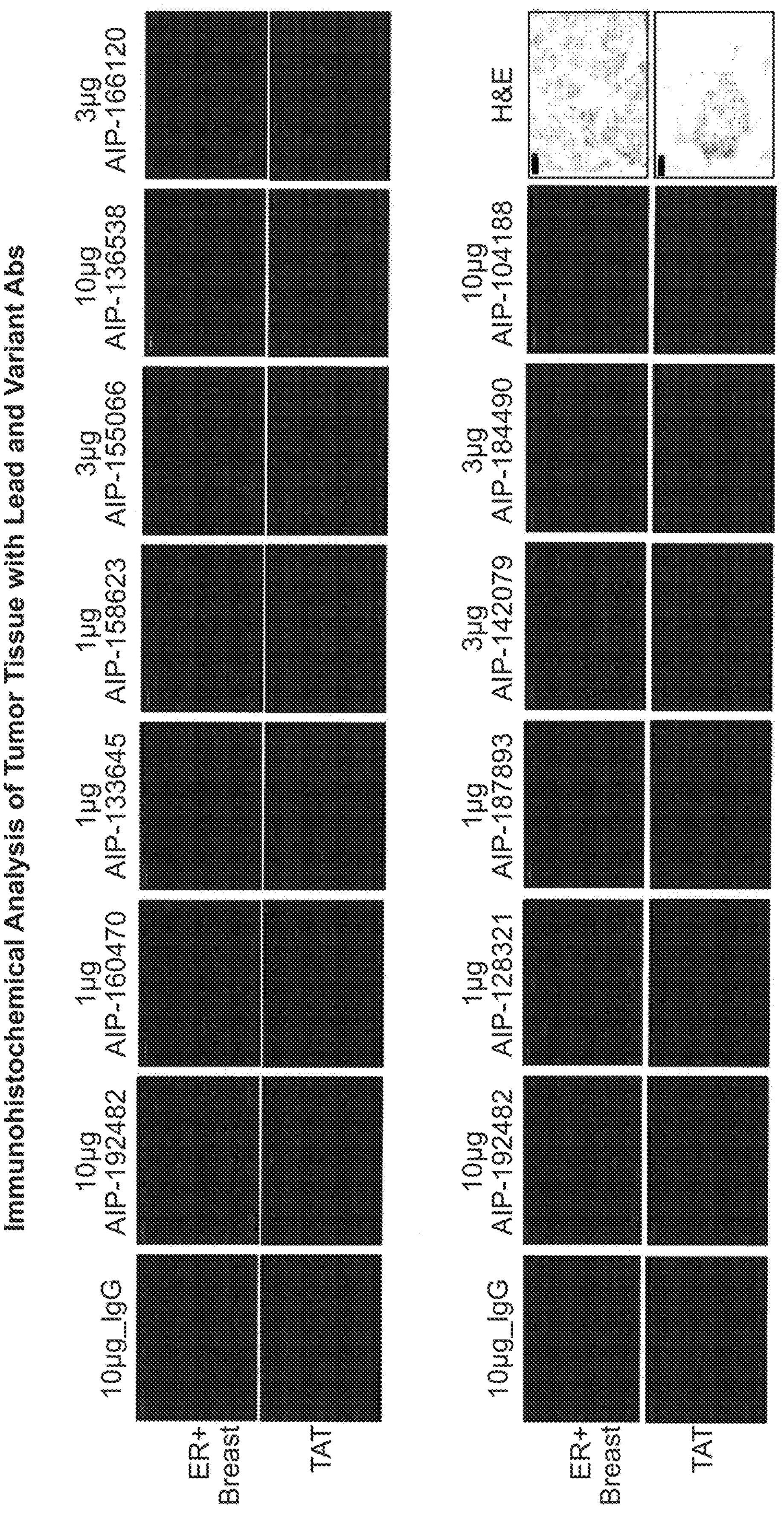
FIG. 22 provides immunohistochemical binding data showing binding of the lead candidate and variants, including antibodies AIP-192482, AIP-160470, AIP-133645, AIP-158623, AIP-155066, AIP-136538, AIP-166120, AIP-187893, AIP-142079, AIP-184490, and AIP-104188, to estrogen receptor-positive breast tumor tissue and TAT.

Binding of variants AIP-160470, AIP-133645, AIP-158623, AIP-155066, AIP-136538, AIP-166120, AIP-187893, AIP-142079, AIP-184490, and AIP-104188 was also evaluated for ER-positive breast tumor tissue and TAT in comparison to binding exhibited by the initial lead antibody. ER-positive breast tumor and TAT sections were stained with H&E and immunostained with the lead antibody, variant, or isotype control (IgG) at 1, 3, and 10 μg/ml. Immunoreactivities were assessed by fluorescent microscopy, and images across concentrations were captured. Positive immunoreactivity (i.e., signal above the IgG control) was detected for the lead and all of the variants (AIP-160470, AIP-133645, AIP-158623, AIP-155066, AIP-136538, AIP-166120, AIP-187893, AIP-142079, AIP-184490, and AIP-104188) with the exception of AIP-136538 (FIG. 22). Images were matched for similar fluorescence intensities in the ER-positive breast cancer cores, regardless of antibody concentration. With the exceptions of AIP-136538 and AIP-104188, all variants tested demonstrated fluorescent intensities within breast tumor similar to that observed with the initial lead antibody, but at 3 to 10-fold lower primary antibody concentrations. Selectivity of tumor labeling vs. TAT binding was also assessed. The ratio of tumor to adjacent tissue signal was markedly enhanced vs. lead with a subset of variants including AIP-160470 and AIP-133645.

Antibody binding to EMT-6 tumors was also evaluated. Tumor samples were harvested from animals approximately 7 days post-inoculation of $10^6$ EMT-6 cells. EMT-6 binding activity was evaluated for variants AIP-157397, AIP-165430, AIP-160470, AIP-133645, AIP-158623, AIP-155066, AIP-136538, AIP-166120, AIP-187893, AIP-142079, AIP-184490, and AIP-104188 (data not shown). The background immunoreactivity was slightly higher in mouse tissue likely due to interactions with endogenous Fc receptors. While all variants exhibited binding to EMT-6 tumor cells, differential signal intensities were apparent between variants.

Figure 23A:
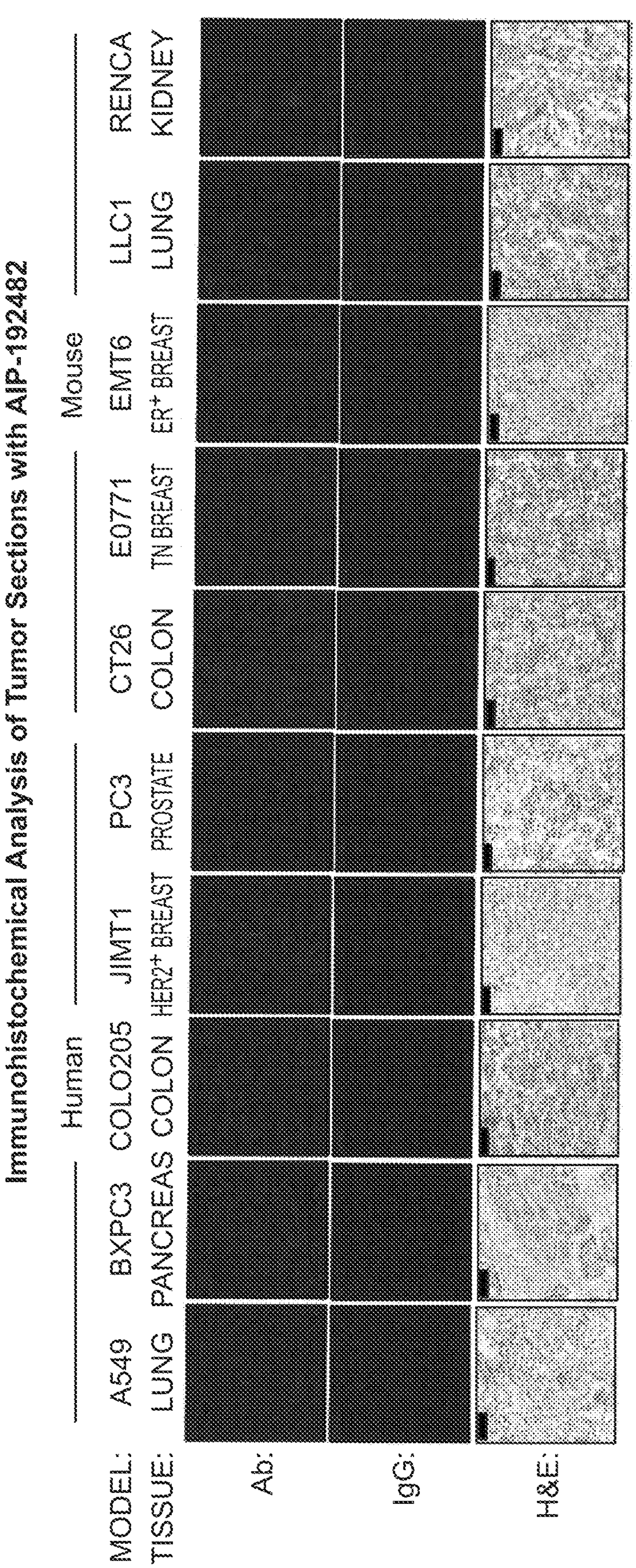
FIGS. 23A-23C provide immunohistochemical data showing binding of initial lead antibody (FIG. 23A), variant AIP-133645 (FIG. 23B), and variant AIP-160470 (FIG. 23C) to tissue from tumors arising from human lung A549 cells, human pancreas BXPC3 cells, human colon cancer Colo-205 cells, or human prostate cancer PC3 cells; and tumor arising from mouse colon, breast, lung, or kidney cancer cell lines.
Figure 23B:
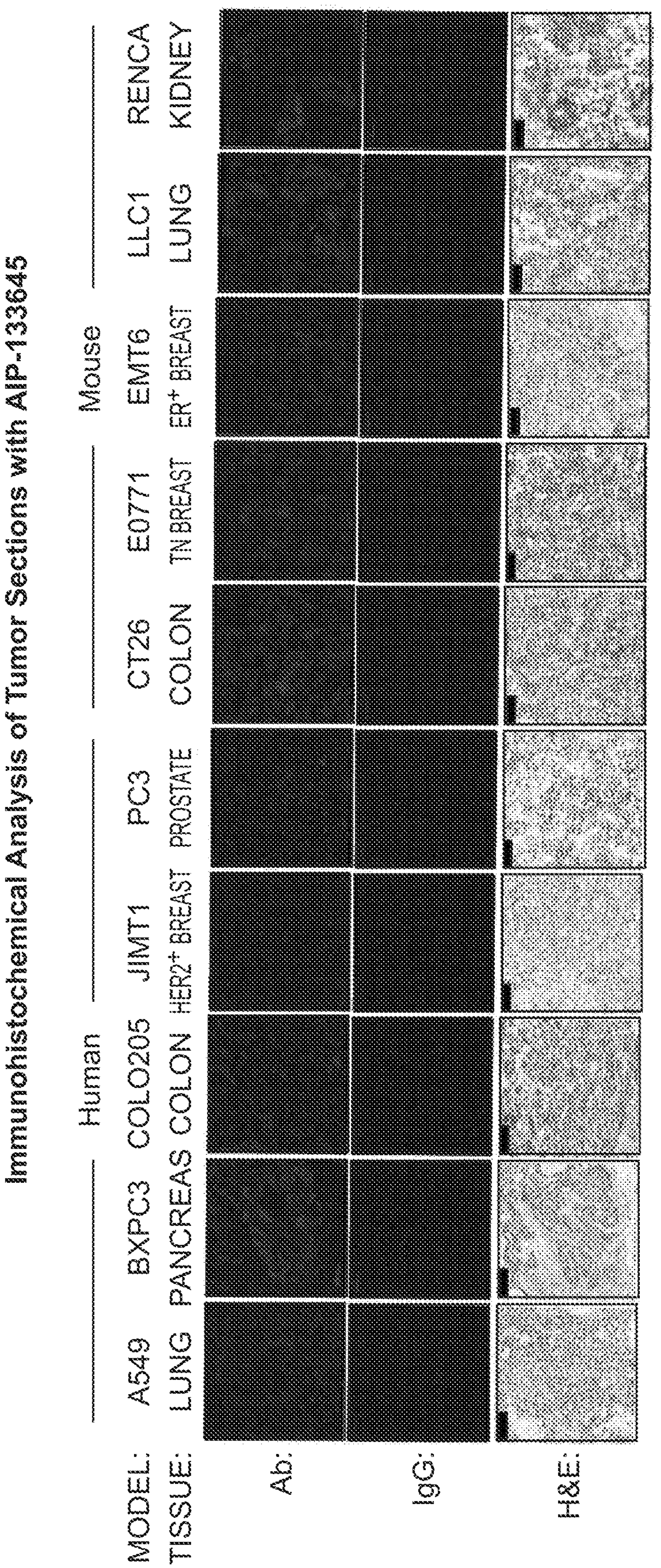
Figure 23C:
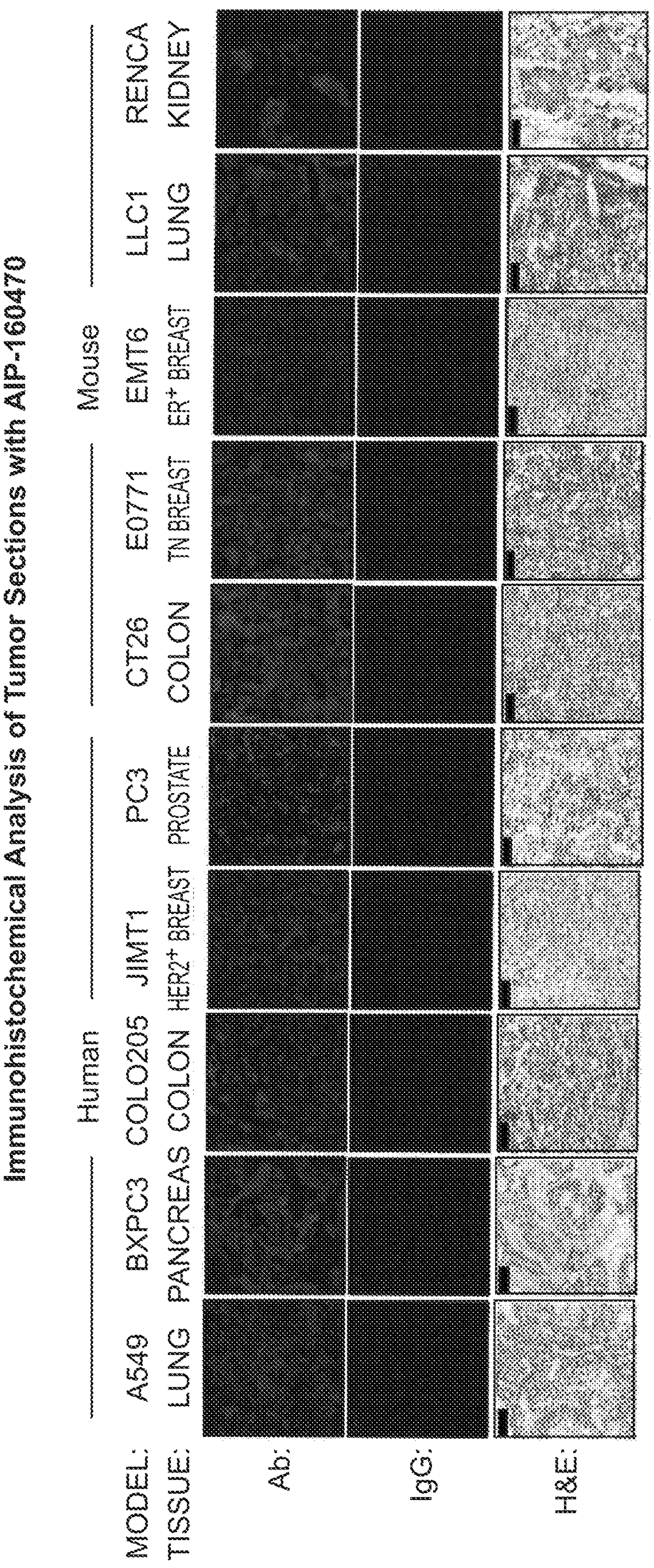

The initial lead antibody (FIG. 23A) and variants AIP-133645 (FIG. 23B) and AIP-160470 (FIG. 23C) were also evaluated for binding to tumor arising in mice inoculated with either human cancer cell lines (xenografts) or mouse cancer cell lines (syngeneic). Frozen tumors were cryosectioned onto slides. Antibodies and isotype control (IgG) were conjugated to AF647, and slides were incubated with the conjugates then counterstained with Hoechst. An adjacent section was also stained using H&E. Tumor sections stained using the variant antibodies showed enhanced signal compared to the lead for all tumors, including tumors arising from human lung A549 cells, human pancreas BXPC3 cells, human colon cancer Colo-205 cells, or human prostate cancer PC3 cells, and tumors arising from mouse colon, breast, lung, or kidney cancer cell lines.

Example 3. Combination Therapy—Histological Analysis

Figure 24:
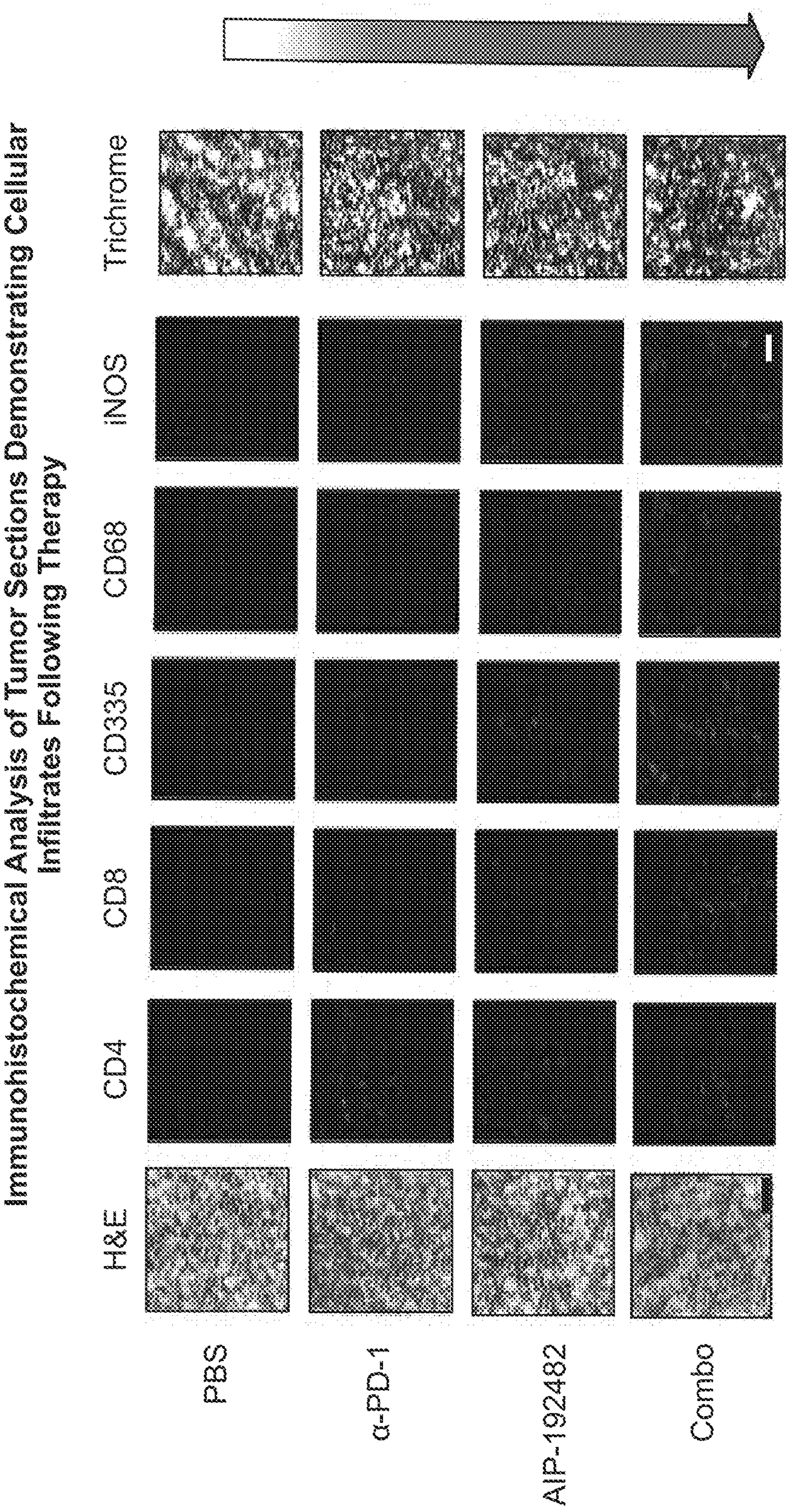
FIG. 24 provides immunohistochemical data showing immune cell infiltration in tumors following treatment with an anti-PD-1 antibody, the initial lead antibody, or the combination of the two antibodies.

The initial lead antibody was evaluated in vivo in the EMT-6 tumor model as a monotherapy and in combination with an anti-PD-1 antibody using a dosing schedule as described in Example 1. EMT-6 tumors from PBS-, anti-PD1-, lead antibody-, or combination therapy-treated cohorts were harvested at two and three weeks post-inoculation and evaluated histologically. Tumor sections were stained with H&E and Masson's trichrome (Trichrome). Immune cell phenotypes and activation state were assessed in tumor sections by immunofluorescence for CD4 (CD4+ T cells), CD8 (CD8+ T cells), CD335 (NK cells), CD68 (macrophages) and iNOS (inducible nitric oxide synthase). Immune cell infiltration was elevated in tumors following treatment with the checkpoint inhibitor at both two (data not shown) and three weeks (FIG. 24) post-inoculation. Further, robust infiltration was observed at both two (data not shown) and three weeks (FIG. 24) in tumors from mice treated with the lead antibody or the combination of lead antibody and checkpoint inhibitor. Increased iNOS immunoreactivity indicated an active pro-inflammatory response in tumors from the lead and combination therapy-treated cohorts.

Example 4. Ex Vivo Binding Assay Correlates with In Vivo Anti-Tumor Activity

Figure 26:
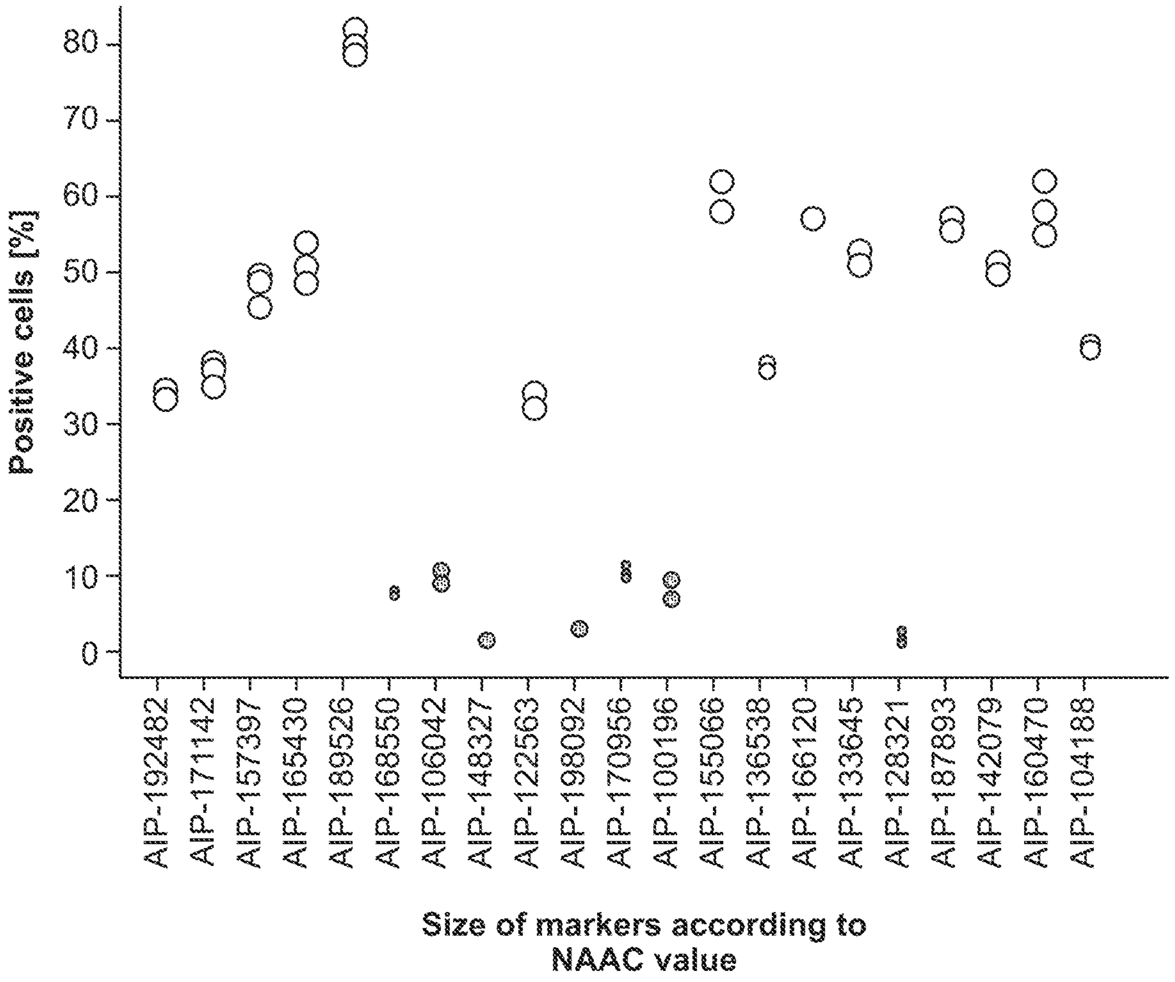
FIG. 26 provides data showing binding of variants to EMT6 ex vivo cells in correlation with in vivo data.
Figure 27:
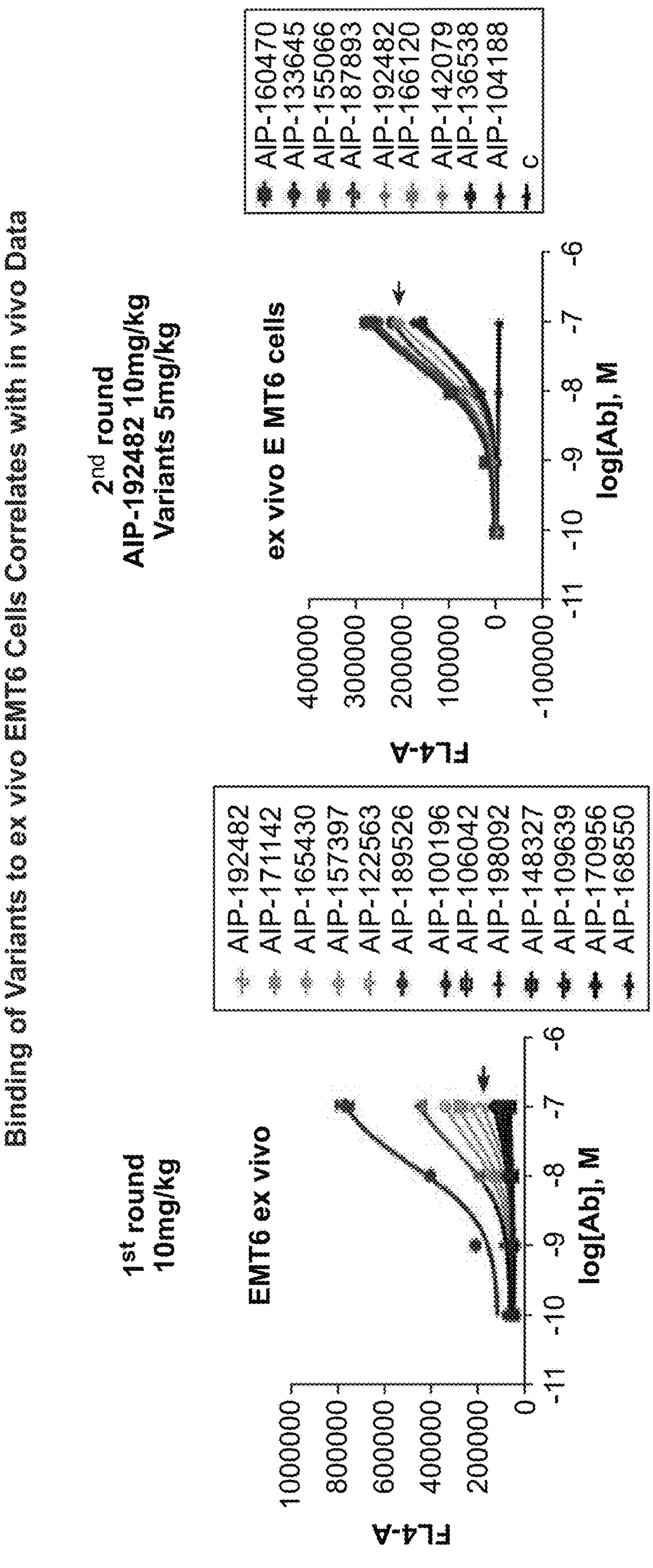
FIG. 27 provides data showing that binding of variants to ex vivo EMT6 cells correlates with in vivo outcome. C=a control anti-EGFR antibody FIG. 28 provides the results of an SDS-PAGE analysis of protein immunoprecipitated with AIP-192482.

The initial lead antibody and variant antibodies were analyzed in an ex vivo binding assay to determine correlation with in vivo anti-tumor activity. A schematic of the ex vivo assay is shown in FIG. 25. Mice were injected with tumor cells and the tumor allowed to grow to a size of about 500-600 $mm^3$. Tumors were harvested, digested, and antibody binding to the surface of live tumor cells analyzed by flow cytometry. Binding was correlated with NAAC values representing tumor volume following in vivo treatment with antibody as described in Example 1. The results showed that binding of antibodies to the ex vivo EMT6 cells largely correlated with in vivo outcome (FIG. 26 and FIG. 27). Ex vivo flow analysis thus provides a screening assay that largely correlates with in vivo function that can be used to identify antibodies that are likely to elicit anti-tumor effects.

Example 5. Analysis of Binding of Antibody to Target

To determine the target on tumor cells to which AIP-192482 binds, immunoprecipitation (IP) was performed with whole cell extracts. A549 cells were incubated overnight in methionine- and cysteine-free media supplemented with $^{35}$S-labeled methionine and cysteine (37° C., 5% $CO_2$). Cells were lysed in radio-immunoprecipitation assay (RIPA) buffer (25 mM Tris-HCl pH 7.6, 150 mM NaCl, 1% NP-40, 1% sodium deoxycholate, 0.1% SDS) followed by 5 washes with buffer (lx phosphate buffer saline supplemented with 450 mM NaCl, 1 mM EDTA, 1% NP-40, 5% glycerol). IP reactions using AIP-192482 or control antibody were performed overnight using antibodies cross-linked to Dynabeads™ M-280 Tosylactivated paramagnetic beads. Beads were then collected on magnets and washed in 450 mM NaCl-containing buffer and eluted with 50 mM Tris, pH 8.0, 1 mM EDTA, and 1% sodium deoxycholate. Radiolabelled antigen bound to antibodies was eluted into 2× reducing SDS-PAGE sample buffer and resolved on 4-20% denaturing SDS-PAGE gels. Resolved proteins were visualized by phosphorimaging autoradiography. For analysis by mass spectrometry (MS), lysates were prepared using A549 cells that had not been metabolically labeled and IP reactions scaled up proportionally. Eluates were then evaluated by nanoLC-MS/MS analysis (performed by Alphalyse and MS Bioworks).

Figure 28:
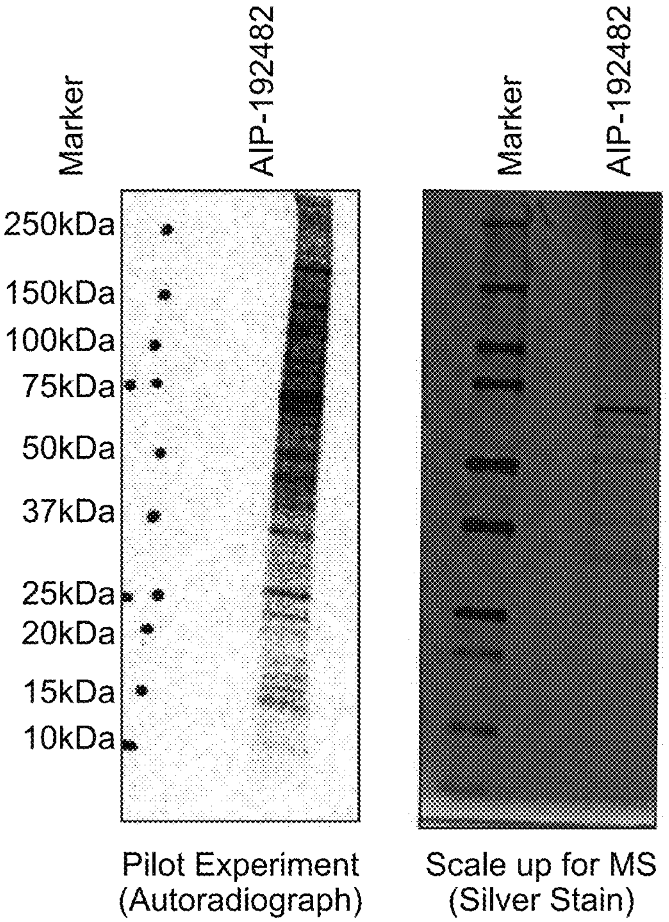

SDS-PAGE analysis (FIG. 28) identified a large number of unique proteins, ranging in size from 15.8 to 152.8 kDa. Numerous RNA-binding proteins were among the proteins identified by MS analysis. A large number of these identified proteins have been shown to be present in stress granules, see Markmiller et al., *Cell,* 172, 590-604, Jan. 25, 2018; and Youn et al., *Molecular Cell,* 69, 517-532 (2018) and Jain et al., *Cell* 164, 487-498 Jan. 28, 2016. Table 3 lists exemplary proteins identified in the immunoprecipitation complex pulled down by AIP-192482. These identified proteins are categorized based on whether they are also known to be in stress granules according to analyses that have been published previously: i) the biochemical isolation analysis on US-02 cells as described in Jain et al. (2016), ii) the APEX (proximity labeling) analysis performed on HEK293 cells as described in Markmiller et al. (2018), iii) the APEX (proximity labeling) analysis performed on neural progenitor cells as described in Markmiller et al. (2018), and iv) BioID (proximity labeling) analysis on HEK293 cells as described in Youn et al. (2018). Group 1 proteins (12 proteins) are among the list of proteins (20 proteins) that have been previously detected in stress granules by all four published analyses. Group 2 proteins (12 proteins) are among those list of proteins (38 proteins) that have been previously detected in stress granules by three of the four published analyses. Group 3 proteins (20 proteins) are among the list of proteins that have been previously detected in stress granules by two of the four published analyses. Group 4 proteins (63 proteins) are among the list of proteins (139) that have been previously detected in stress granules by Jain et al.

TABLE 3

Exemplary proteins in the immunoprecipitation complex identified by MS

| Group 1 TOTAL = 12/20 (60%) | Group 2 TOTAL = 12/38 (32%) | Group 3 TOTAL = 20/61 (33%) | Group 4 TOTAL = 63/139 (45%) |
|---|---|---|---|
| ATXN2 | DHX36 | CASC3 | ACIN1 |
| FAM120A | ELAVL1 | CELF1 | ADAR |
| FUBP3 | FMR1 | DDX6 | ATXN2 |
| FXR1 | FXR2 | EDC4 | BAG2 |
| IGF2BP1 | HNRNPA1 | FUS | DDX17 |
| IGF2BP2 | HNRNPAB | GRSF1 | DDX21 |
| IGF2BP3 | PABPC1 | HNRNPA3 | DDX5 |
| PABPC4 | PCBP2 | HNRNPDL | DHX15 |
| STAU2 | PRRC2C | HNRNPH1 | DHX30 |
| SYNCRIP | PUM1 | HNRNPUL1 | DHX9 |
| UPF1 | RBMX | MOV10 | EDC4 |
| YBX3 | ZC3HAV1 | PTBP1 | EFTUD2 |
| | | PTBP3 | EIF4A3 |
| | | RBM4 | ELAVL1 |
| | | SND1 | FAM120A |
| | | SRSF9 | FBL |
| | | TNRC6A | FTSJ3 |
| | | TRIM25 | FUBP3 |
| | | TRIM56 | FUS |
| | | YBX1 | FXR1 |
| | | | HNRNPA0 |
| | | | HNRNPA1 |

TABLE 3-continued

| Exemplary proteins in the immunoprecipitation complex identified by MS | | | |
|---|---|---|---|
| Group 1 TOTAL = 12/20 (60%) | Group 2 TOTAL = 12/38 (32%) | Group 3 TOTAL = 20/61 (33%) | Group 4 TOTAL = 63/139 (45%) |
| | | | HNRNPA3 |
| | | | HNRNPC |
| | | | HNRNPD |
| | | | HNRNPH1 |
| | | | HNRNPH3 |
| | | | HNRNPL |
| | | | HNRNPR |
| | | | HNRNPUL1 |
| | | | IGF2BP1 |
| | | | IGF2BP2 |
| | | | IGF2BP3 |
| | | | ILF2 |
| | | | ILF3 |
| | | | MATR3 |
| | | | MOV10 |
| | | | NOP56 |
| | | | PABPC1 |
| | | | PABPC4 |
| | | | PCBP2 |
| | | | PLEC |
| | | | PRPF8 |
| | | | PTBP1 |
| | | | RALY |
| | | | RBM14 |
| | | | RBMX |
| | | | RPL14 |
| | | | RPL4 |
| | | | RPS8 |
| | | | RRBP1 |
| | | | SF3B3 |
| | | | SNRNP200 |
| | | | SRRM2 |
| | | | SRSF10 |
| | | | STAU2 |
| | | | SYNCRIP |
| | | | TARDBP |
| | | | TRIM25 |
| | | | TRIM56 |
| | | | UPF1 |
| | | | YBX3 |
| | | | ZC3H7A |

As shown in Table 3 above, there was a significant overlap between the list of proteins identified in the immunoprecipitations using AIP-192482 and those known to be present in stress granules according to published literature. Further, contrary to the prevailing view that so little PABPC1 partitions into stress granules in cells under stress (6% according to Wheeler et al., Methods 126:12-17 (2017) to permit immunoprecipitations of stress granules from crude lysates by using an antibody binding PABPC1, as shown above, AIP-192482 immunoprecipitated complexes comprising PABPC1 successfully, directly from whole cell lysates.

Additional proteins identified in the MS that were present in AIP-192482 immunoprecipitates at a level of 2-fold or greater, or with a score of 2 or greater, compared to control immunoprecipitates are:

ABCF1, ACIN1, ACLY, ADAR, AGO1, AGO2, AGO3, AHNAK, ATP2A2, ATXN2, BAG2, BOP1, BUB3, CAD, CASC3, CDC5L, CELF1, CLTA, CNBP, COPA, CRNKL1, DARS, $DDX_{17}$, $DDX_{18}$, $DDX_{21}$, $DDX_5$, $DDX_{54}$, $DDX_6$, $DHX_{15}$, $DHX_{30}$, $DHX_{36}$, $DHX_{57}$, $DHX_9$, DICER1, DKC1, DNTTIP2, EDC4, EEF1D, EEF2, EFTUD2, EIF2AK2, EIF2S1, EIF3D, EIF3E, EIF3I, EIF4A3, EIF4G1, EIF6, ELAVL1, EPRS, FAM120A, FBL, FMR1, FTSJ3, FUBP3, FUS, FXR1, FXR2, GAR1, GEMIN4, GNL3, GRSF1, GTPBP4, HEATR1, HIST1H1B, HIST1H1C, HIST1H3A, HNRNPA0, HNRNPA1, HNRNPA2B1, HNRNPA3, HNRNPAB, HNRNPC, HNRNPD, HNRNPDL, HNRNPF, HNRNPH1, HNRNPH3, HNRNPK, HNRNPL, HNRNPM, HNRNPR, HNRNPUL1, HNRNPUL2, IGF2BP1, IGF2BP2, IGF2BP3, ILF2, ILF3, KARS, KHDRBS1, L1RE1, LARP1, MAGOHB, MAK16, MAP1B, MATR3, MBNL1, MOV10, MRTO4, MVP, MYBBP1A, MYO1B, NAT10, NCL, NHP2, NIFK, NKRF, NOL11, NOL6, NOP2, NOP56, NOP58, PABPC1, PABPC4, PCBP2, PDCD11, PES1, PGD, PLEC, PPP1CB, PRKDC, PRKRA, PRPF19, PRPF4B, PRPF8, PRRC2C, PTBP1, PTBP3, PUM1, PURA, PURB, PWP1, PWP2, RAB14, RAB2A, RACK1, RALY, RAN, RBM14, RBM34, RBM4, RBM45, RBM8A, RBMX, RCC2, RPL10A, RPL11, RPL12, RPL13A, RPL14, RPL15, RPL17, RPL18, RPL18A, RPL19, RPL21, RPL22, RPL23, RPL23A, RPL24, RPL26, RPL27, RPL29, RPL3, RPL30, RPL32, RPL34, RPL35A, RPL36, RPL4, RPL5, RPL6, RPL7, RPL7A, RPL8, RPLP0, RPLP1, RPLP2, RPS11, RPS13, RPS17, RPS23, RPS24, RPS26, RPS27A, RPS3, RPS3A, RPSS, RPS6, RPS8, RPS9, RPSA, RRBP1, RRP1, RRP9, RRS1, RSL1D1, RTCB, RUVBL2, RYDEN, SART3, SF3B3, SKIV2L2, SLC3A2, SND1, SNRNP200, SNRNP70, SNRPB, SNRPD1, SNRPD2, SNRPD3, SON, SRP68, SRP72, SRPK1, SRPK2, SRRM2, SRSF1, SRSF10, SRSF2, SRSF3, SRSF6, SRSF7, SRSF9, SSB, STAU1, STAU2, STRAP, SYNCRIP, TARBP2, TARDBP, TCOF1, TCP1, THOC2, THOC6, TNRC6A, TOP1, TRA2A, TRA2B, TRIM25, TRIM56, TTN, U2AF2, UGDH, UPF1, UTP15, UTP18, UTP4, UTP6, WDR12, WDR36, WDR43, WDR46, WDR74, WDR75, XAB2, XRCCS, XRN2, $YBX_1$, $YBX_3$, YTHDC2, ZC3H7A, ZC3HAV1, ZCCHC3, and ZNF326.

Figure 29:
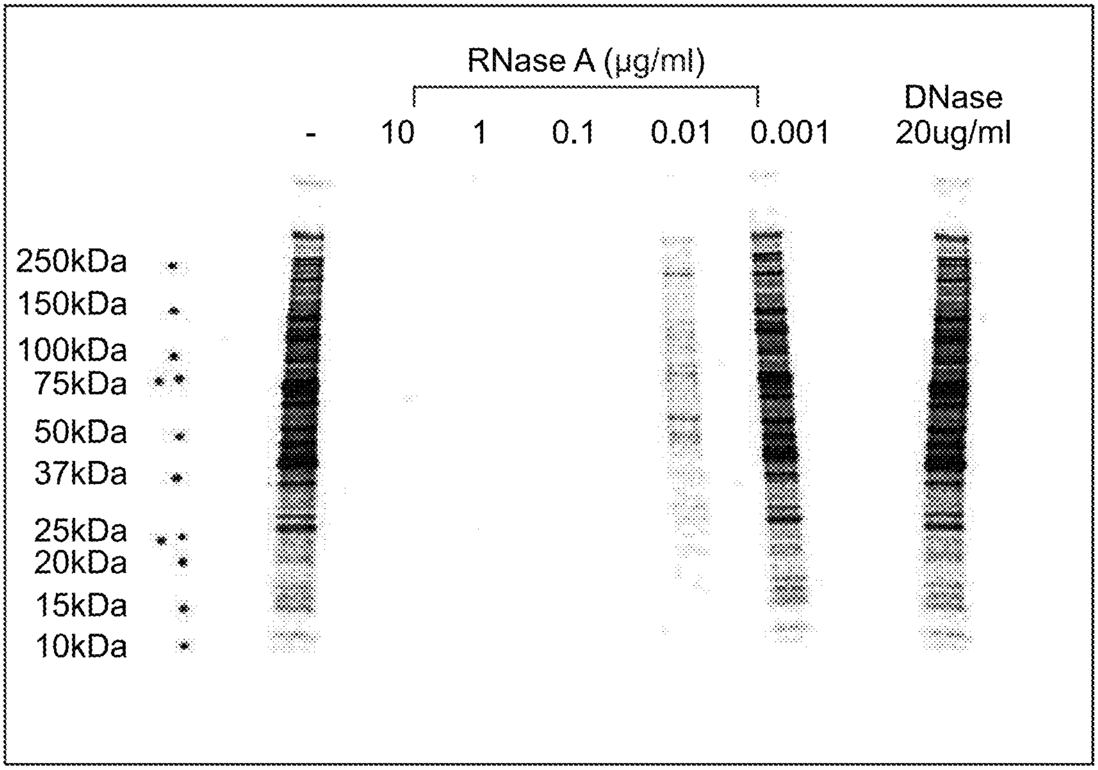
FIG. 29 provides the results of an analysis of AIP-192482-target complex immunoprecipitates treated with RNase or DNase.
Figure 38A:
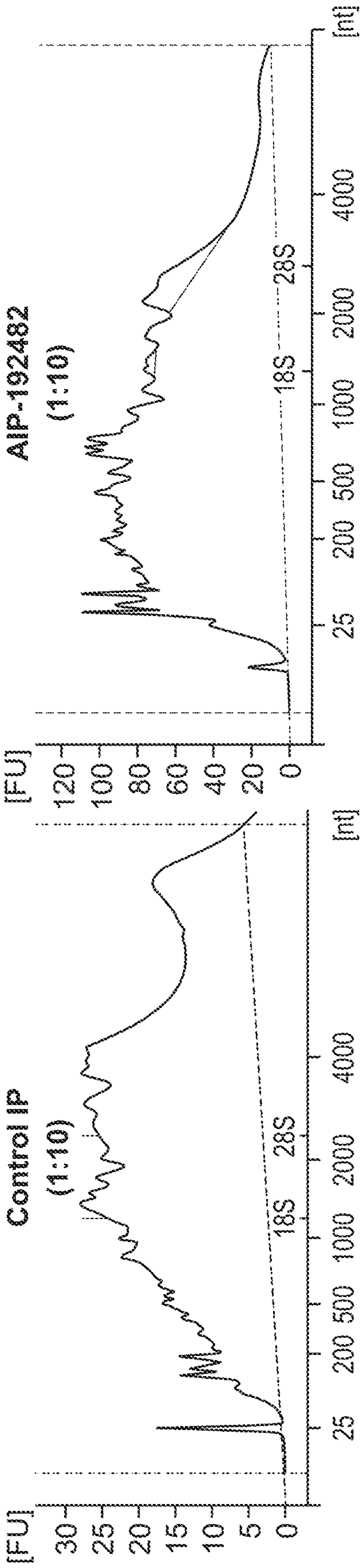

To test whether RNA is part of a complex to which AIP-192482 binds, lysates were prepared from radiolabelled A549 cells and then treated with increasing amounts of RNase A (from 0.001 to 10 μg/ml) or DNAse I (20 μg/ml). Treated lysates were employed in IP using AIP-192482. Bound proteins were analyzed by SDS-PAGE followed by autoradiography. Results showed that treatment with RNase, but not DNase, eliminated proteins immunoprecipitated by AIP-192482 in an RNase dose-dependent fashion (FIG. 29). This effect was specific to the AIP-192482 antigen since no such effect was observed for EGFR binding to an anti-EGFR control antibody (data not shown). This result indicated that RNA contributes to AIP-192482 binding to its target (see, FIGS. 38A and 38B).

Figure 30:
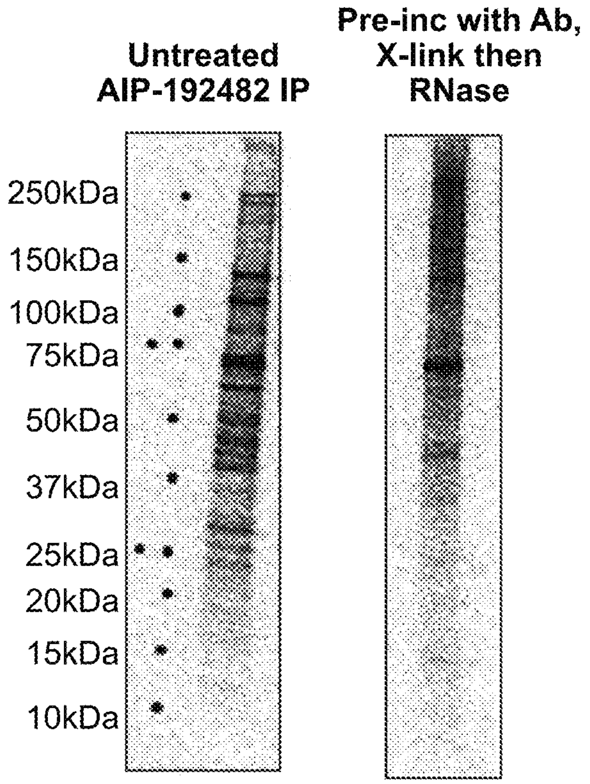
FIG. 30 shows the results of SDS PAGE analysis of immunoprecipitation using lysate from unlabelled A549 cells s incubated with AIP-192482-conjugated M-280 beads and then crosslinked.

Additional MS analysis was performed to identify the composition of the target. IN one such analysis, RIPA lysate prepared from unlabelled A549 cells was incubated with AIP-192482-conjugated M-280 beads and then crosslinked using DTSSP (ThermoFisher). After quenching, lysates were treated with RNase (100 ng/ml). Beads were washed in high salt buffer and antigen eluted using 0.5 N ammonium hydroxide before performing nanoLC-MS/MS (MS Bioworks). In gel digestion was performed and proteins analyzed. One RNA binding protein, PABPC1, was present in high abundance in results from all MS runs and was enriched following RNase treatment (FIG. 30).

Figure 31:
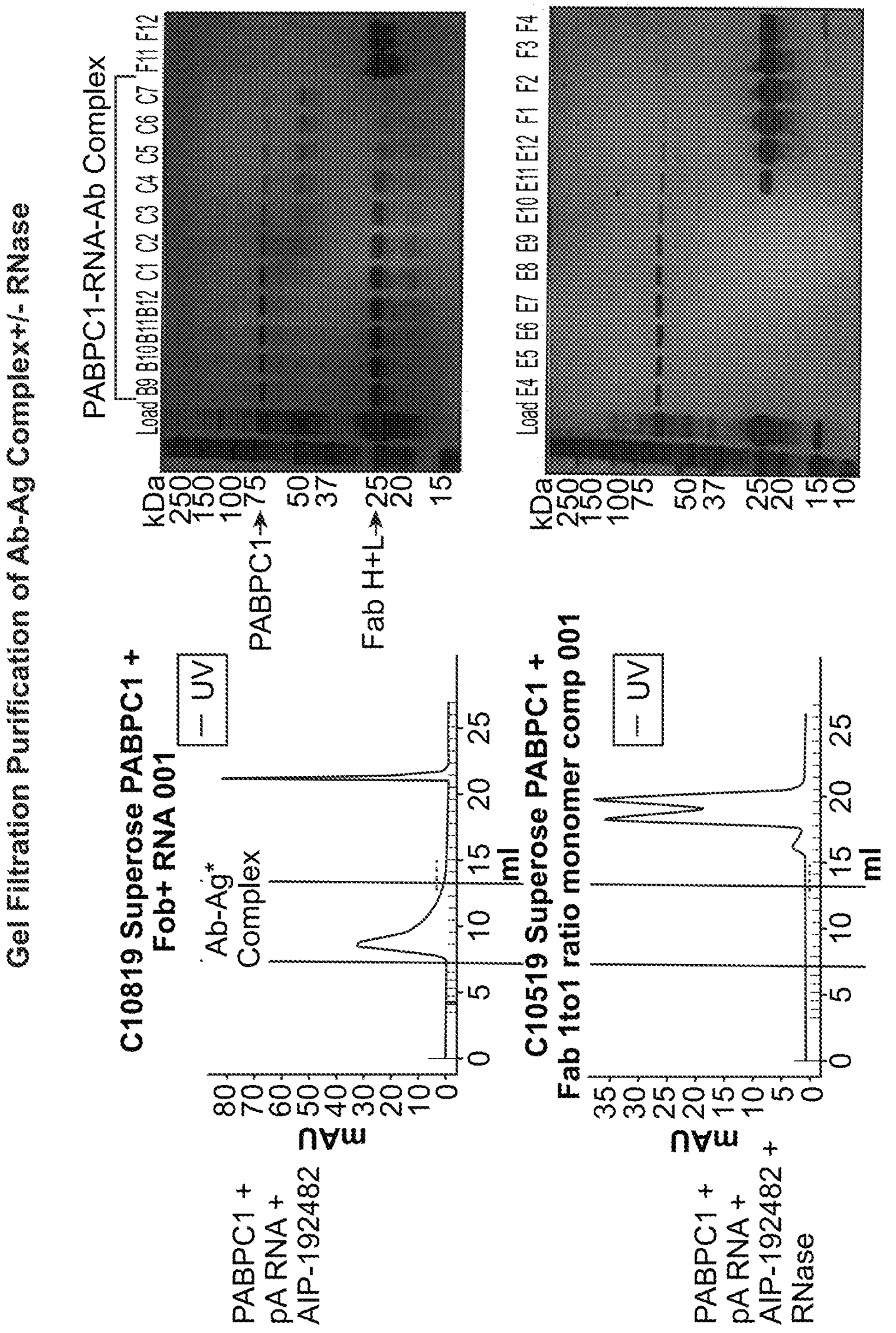
FIG. 31 shows gel filtration purification of AIP-192482-antigen complex with and without RNase treatment and SDS PAGEe analysis of column fractions.
Figures 32A, 32B, 32C, 32D:
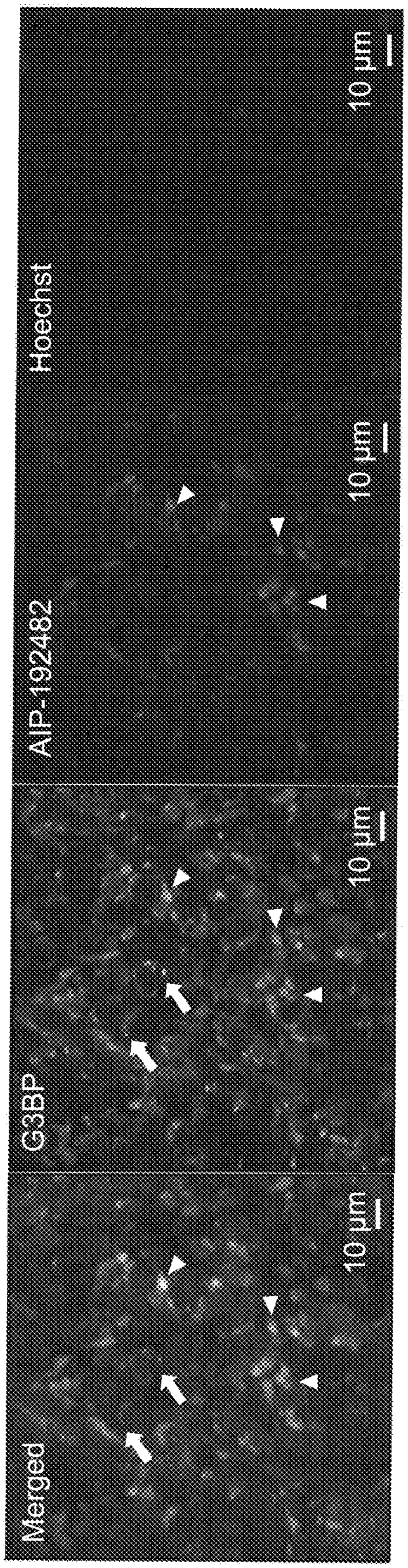
FIG. 32A-D show results of immunofluorescence imaging experiments showing an extensive overlap between AIP-192482 signal and signal for G3BP, a marker of stress granules. The results also show that although a subset of these G3BP-positive structures, i.e., very small puncta, are not positive for AIP-192482 immunoreactivity, in larger aggregates, which are more heterogeneous in structure, the reactivity co-locates.
Figure 33A:
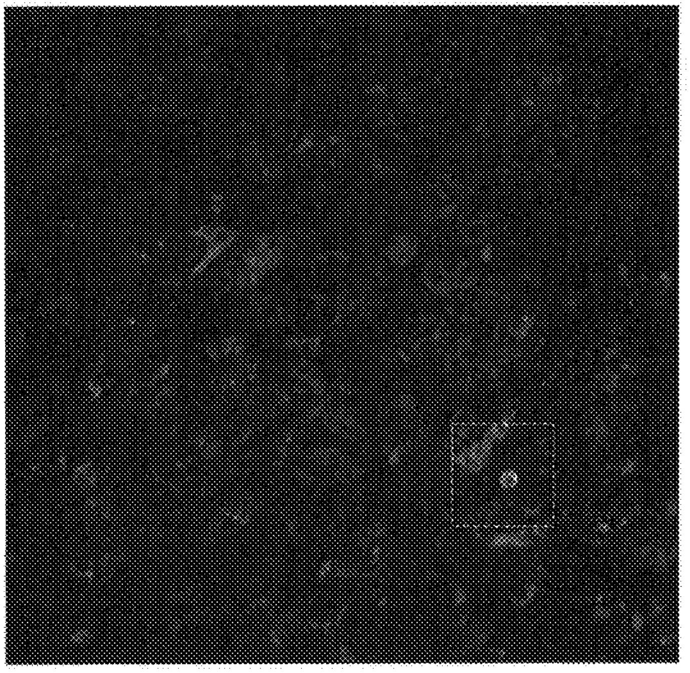
FIG. 33A-D show results of a confocal imaging experiment performed on an EMT6 tumor tissue. A spherical object (indicated by the dotted rectangle) of about 4 μm in diameter was highlighted with fluorescent staining, indicating that it reacted on its surface with AIP-160470 and has CD9 reactivity in its lumen. CD9 is a tetraspanin, which has been reported to be a marker of extracellular vesicles.
Figure 33B:
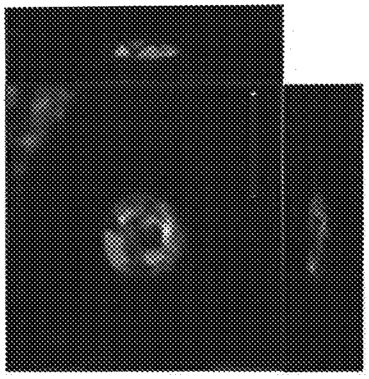
Figure 33C:
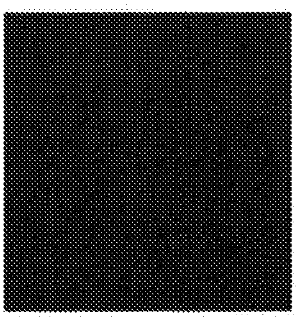
Figure 33D:
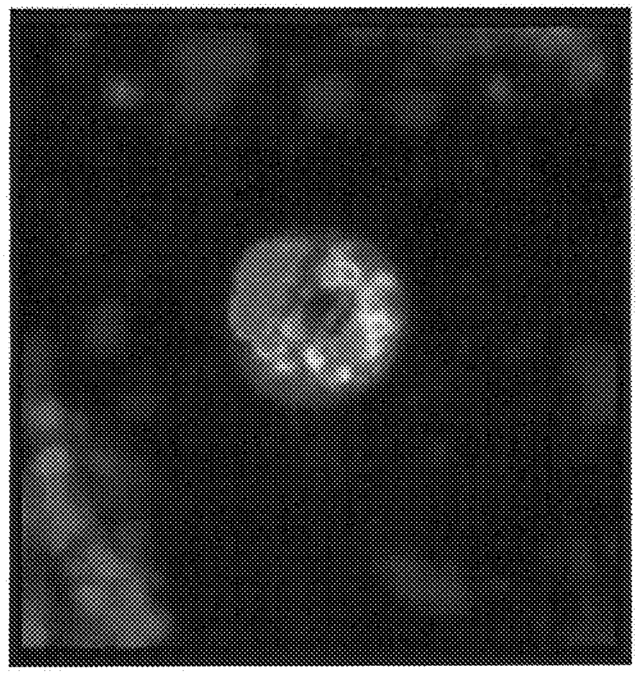
Figure 34A:
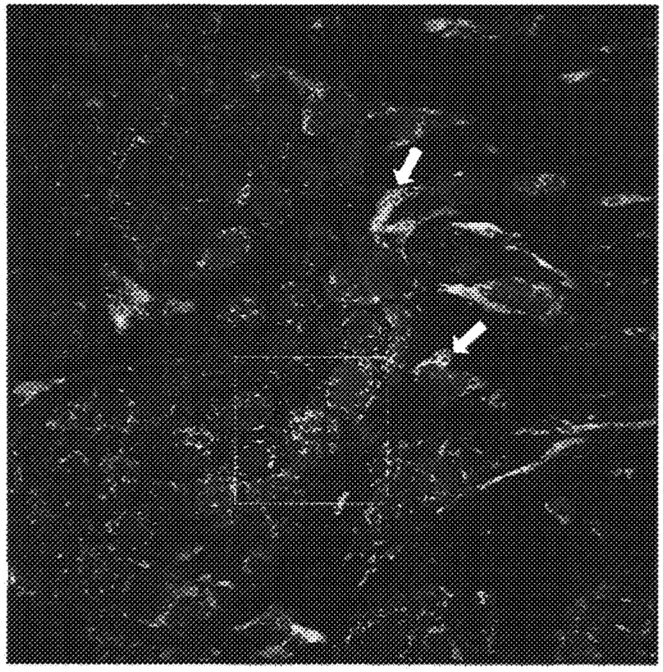
FIG. 34A-34D show results of confocal imaging experiments performed on a human breast carcinoma tissue. The images show a mass of CD9-positive vesicles of about 1 μm diameter embedded in signal from AIP-160470 (indicated by white arrows).
Figure 34B:
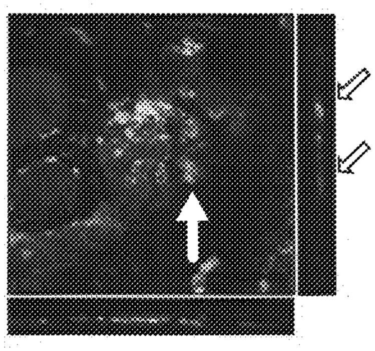
Figure 34C:
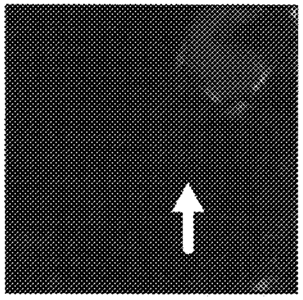
Figure 34D:
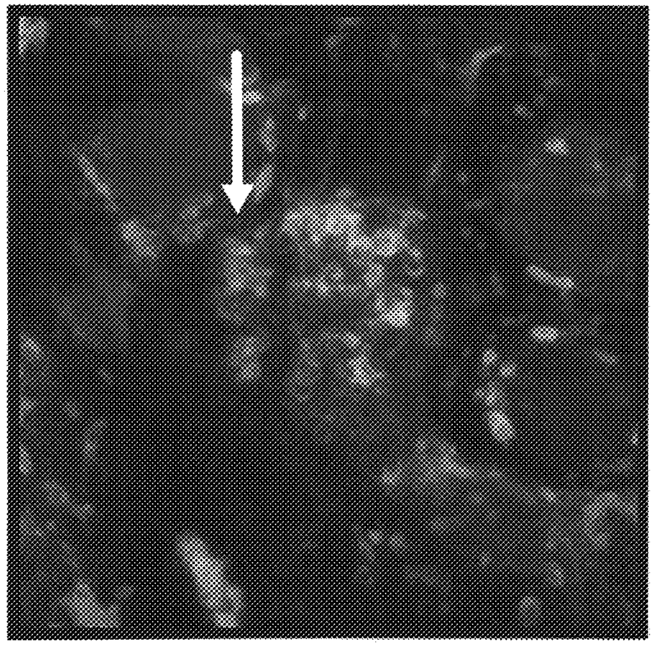

PABPC1 was expressed as a C-terminal FLAG fusion in 293T cells transiently transfected with a human PABPC1-FLAG expression plasmid and purified by anti-FLAG antibody chromatography. Purified PABPC1 was incubated with purified poly(A) RNA (56mer) produced via in vitro transcription of a linearized plasmid template driven by a T7 promoter. Complexed PABPC1-RNA was then incubated with monovalent AIP-192482 Fab and resulting complexes resolved on a Superose 6 gel filtration column (GE Lifesciences) at a final ratio of 15:15:1 PABPC1: AIP-192482 Fab: RNA by mass. $A_{280}$ absorbance of column eluate and SDS-PAGE analysis of column fractions (FIG. 31) indicated that AIP-192482 Fab, PABPC1 and poly(A) RNA form a high molecular size complex that elutes from the column markedly before the individual components. RNase A was also included in an AIP-192482 incubation step prior to column chromatography. A high molecular size complex was not observed for this sample.

As explained above, MS results from crosslinked, RNAse treated immunoprecipitate from A549 cells obtained using AIP-192482 showed the presence of PABPC1 in the immunoprecipitate. PABPC3/4, MOV10, UPF1, and other proteins were also identified as components present in the immunoprecipitate.

Example 6. Confocal Imaging Showing Localization and Components of the Complexes Targeted by the Antibodies Immunofluorescence microscopy was performed on EMT6 tumor tissues stained with antibodies. AIP-192482 was shown to co-localize with a subpopulation of G3BP-positive structures within the EMT6 tumors. See FIG. 32A-D. The images showed an extensive overlap between AIP-192482 signal and signal for G3BP, another marker of stress granules. The results show a presence of smaller G3BP puncta that are not positive for AIP-192482. Although a subset of these G3BP-positive structures, i.e., very small puncta, are not positive for AIP-192482 immunoreactivity, in larger aggregates, which are more heterogeneous in structure, the reactivity co-locates. This suggests that AIP-192482 associates with complexes with RNPs.

The antibodies disclosed herein were shown to target protein complexes located extracellularly via confocal microscopy. As shown in FIG. 33A-D, AIP-160470 reacted where CD9 reactivity was also detected. The confocal imaging shows that the AIP-160470 reactivity is clearly extracellular in nature, which corroborates the flow cytometry data as described below. Similar confocal microscopy experiments were performed with human breast carcinoma tissue, which also showed that AIP-160470 co-localized with numerous CD9-positive vesicles about 1 μm diameter that appeared extracellular.

Additional confocal microscopy imaging showed that AIP-160470 signal co-located with RNA binding proteins, including PABPC1 and MOV10, and labeling was consistent with extracellular punctae and plasma membrane in human ovarian cancer tissue.

Figures 35A, 35B:
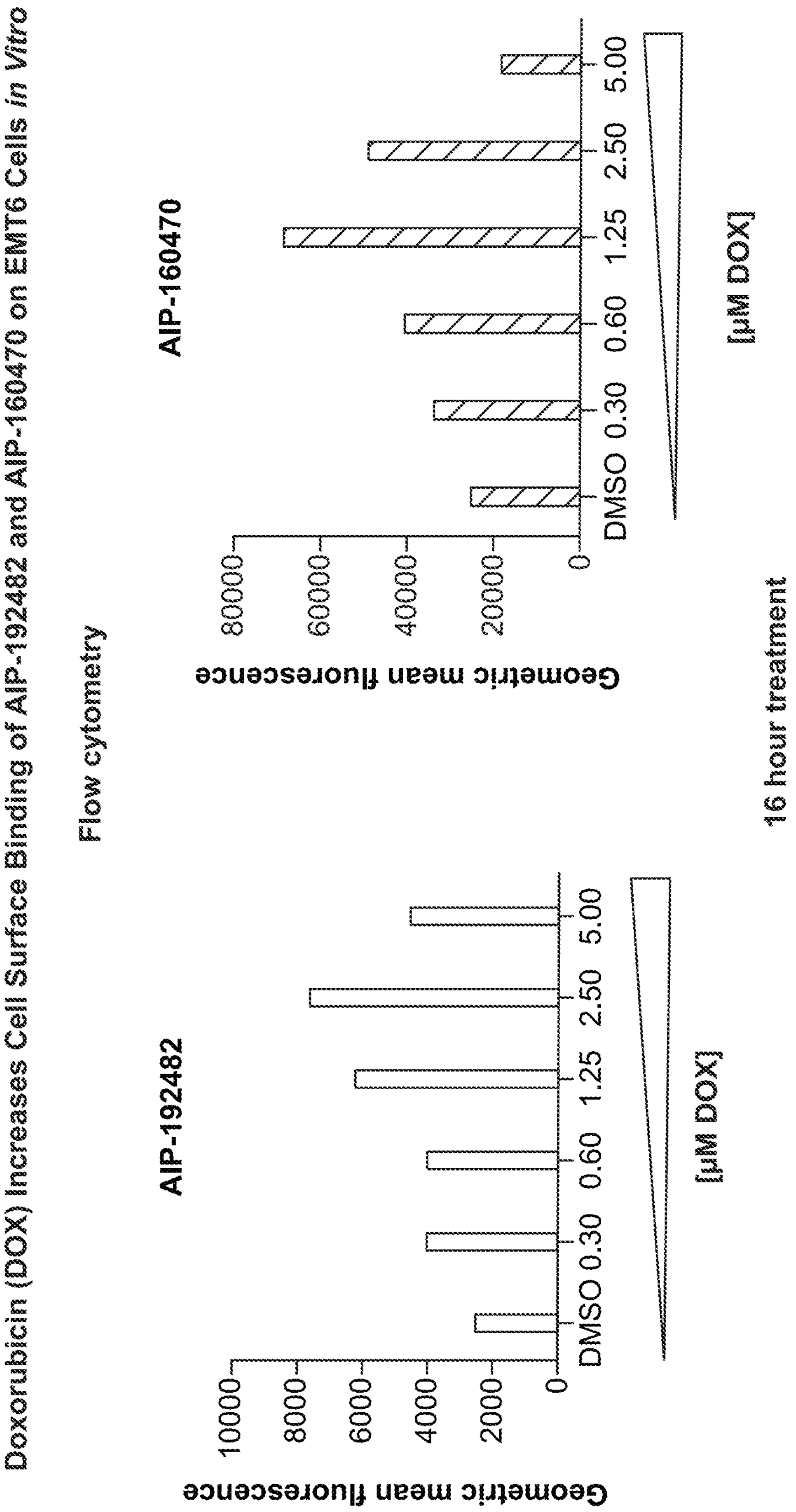
FIGS. 35A and 35B show flow cytometry analysis of EMT6 cells stained with AIP-192482 and AIP-160470 after being treated with chemotherapeutic agent doxorubicin ("DOX") for 16 hours in vitro. Geometric mean fluorescence corresponding to the binding of antibodies to the EMT6 cells detected by flow cytometry were plotted against concentrations of the DOX used to treat the EMT6 cells. The results show that the DOX induced surface reactivity over time for AIP-192482 and AIP-160470 in EMT6 cells. These data complement the data in FIG. 33 that shows growth of EMT6 cells in vivo also induces such surface reactivity.
Figure 36:
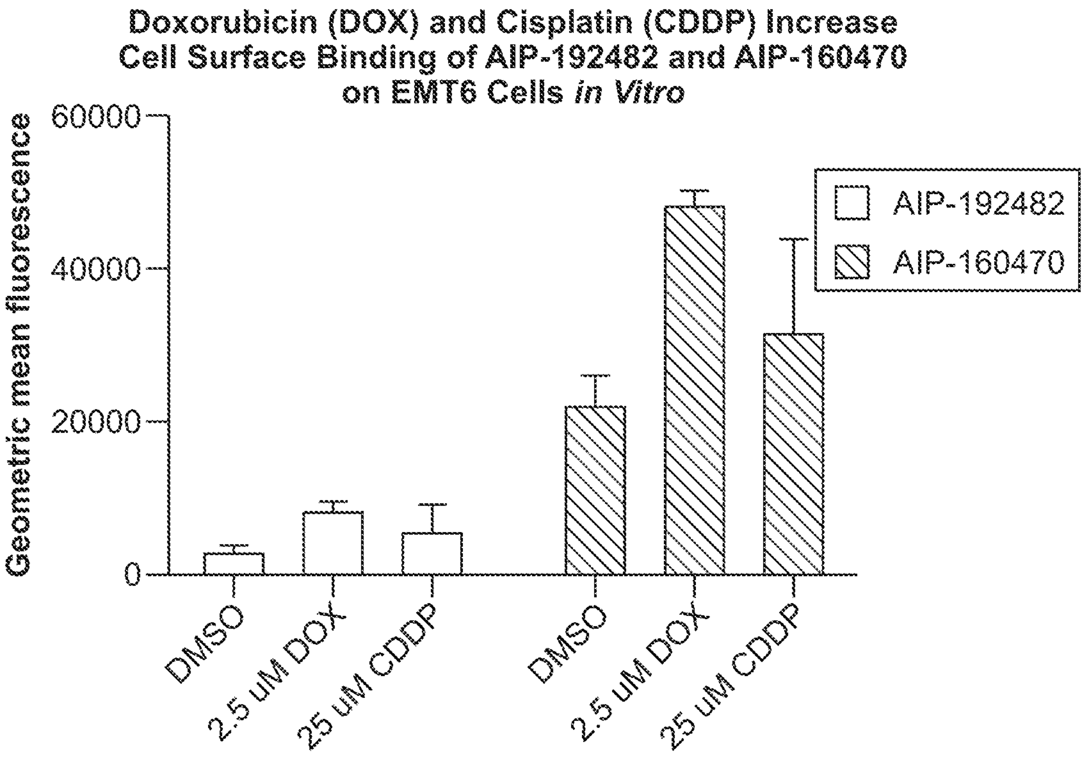
FIG. 36 shows surface reactivity induced by both doxorubicin ("DOX") and cisplatin ("CDDP") in EMT6 cells.

Example 7. Flow Cytometry Showing the Surface Localization of the Complexes Targeted by the Antibodies EMT6 cells were treated with a chemotherapeutic agent, doxorubicin ("DOX") or cisplatin ("CDDP"), for 16 hours. Both DOX and CDDP are known inducers of stress granules, Vilas-Boas, et al., *J Neurooncol* 127:253-260 (2016); and Morita et al., *Biochemical and Biophysical Research Communications* 417: 399-403 (2012). The treated cells were plated in a 96 well plate and stained with AIP-192482, AIP-160470, or AIP-195694 (negative control). The cells were then stained with a secondary antibody that was conjugated with Alexa 647 and analyzed on a flow cytometer. Geometric mean fluorescence corresponding to the binding of antibodies to the EMT6 cells were plotted against concentrations of the chemotherapeutic agents used in treating cells, see FIG. 35A-B and FIG. 36. These data show that these antibodies were bound to the surface of the cells, which complement the confocal data in FIG. 33, which shows growth of EMT6 cells in vivo also induces such surface reactivity. This extracellular, surface localization is also corroborated by the ex vivo flow analysis of Example 4.

Example 8. Generation of Variants of AIP-160470

Antibody variants of AIP-192482 were evaluated in examples described above. Numerous additional antibody variants were generated by introducing various substitutions into the CDRs, using AIP-160470 as a parental comparison sequence. Variants were tested in an in vitro Fc receptor engagement assay. The variants included individual substitutions introduced across each CDR, as well as variants in which up to four substitutions were introduced into HCDR1, up to five substitutions were introduced into HCDR2, up to thirteen substitutions were introduced into HCDR3, up to six substitutions were introduced into LCDR1, up to three substitutions were introduced into LCDR2, and up to six substitutions were introduced into LCDR3. Combinations of variant CDR1, CDR2, and CDR3 sequences were also tested. Variants were tested for in vitro activity and a subset was tested for in vivo anti-tumor activity as described below. The CDR sequences of active variants are provided in Table 1B and Table 2B.

In Vitro Activity

Activity of antibodies in vitro was determined using an FcR engagement assay. Variants were tested in a FcγRIIa-H ADCP Reporter Bioassay (Promega). This assay is used to measure the potency and stability of antibodies that specifically bind and activate FcγRIIa. The assay employed Jurkat cells stably expressing human FcγRIIa-H (the high-affinity H131 variant) and NFAT-induced luciferase. Following engagement of an FcγR on Jurkat effector cells by the Fc region of a test antibody binding to a target cell, intracellular signals are generated in the Jurkat cells that result in NFAT-RE-mediated luciferase activity, which can be quantified. The assay used to analyze variants is detailed in the "Detailed Methodology" section below.

The activity of variants active in the in vitro assay are shown in FIG. 39. Variants are deemed active if they exhibited an $EC_{50}$ of 500 nM or less; or if they have a delta activity value, relative to AIP-160470, of at least 0.5, as shown in FIG. 39. An antibody that has a delta-value, relative to AIP-160470, of zero is considered to be inactive. The scoring of activity is described below in the "Detailed Methodology" section.

In Vivo Activity of Variants

Figure 43:
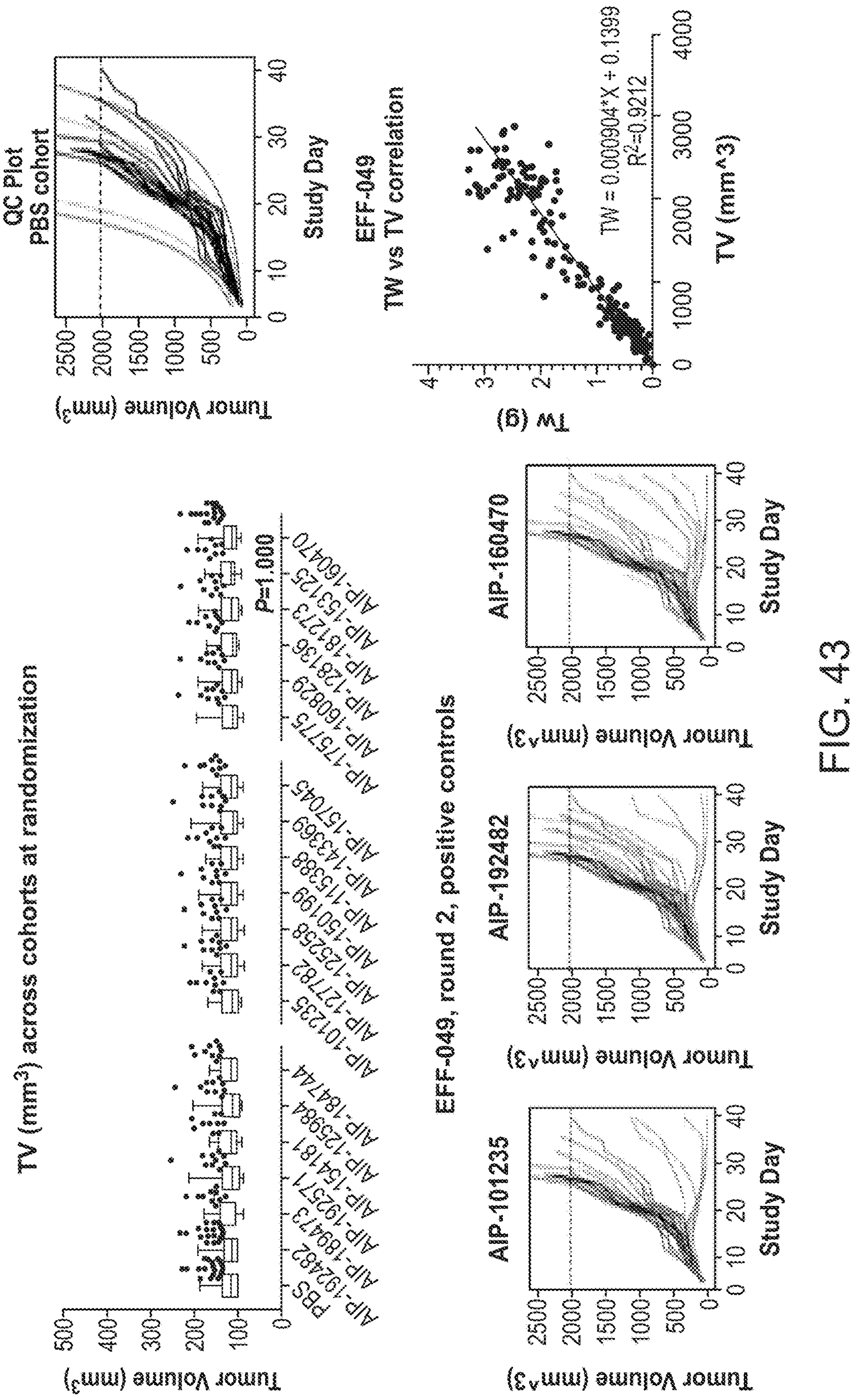
FIG. 43 provides data showing the tumor volume across cohorts at randomization in Round 2.
Figure 44:
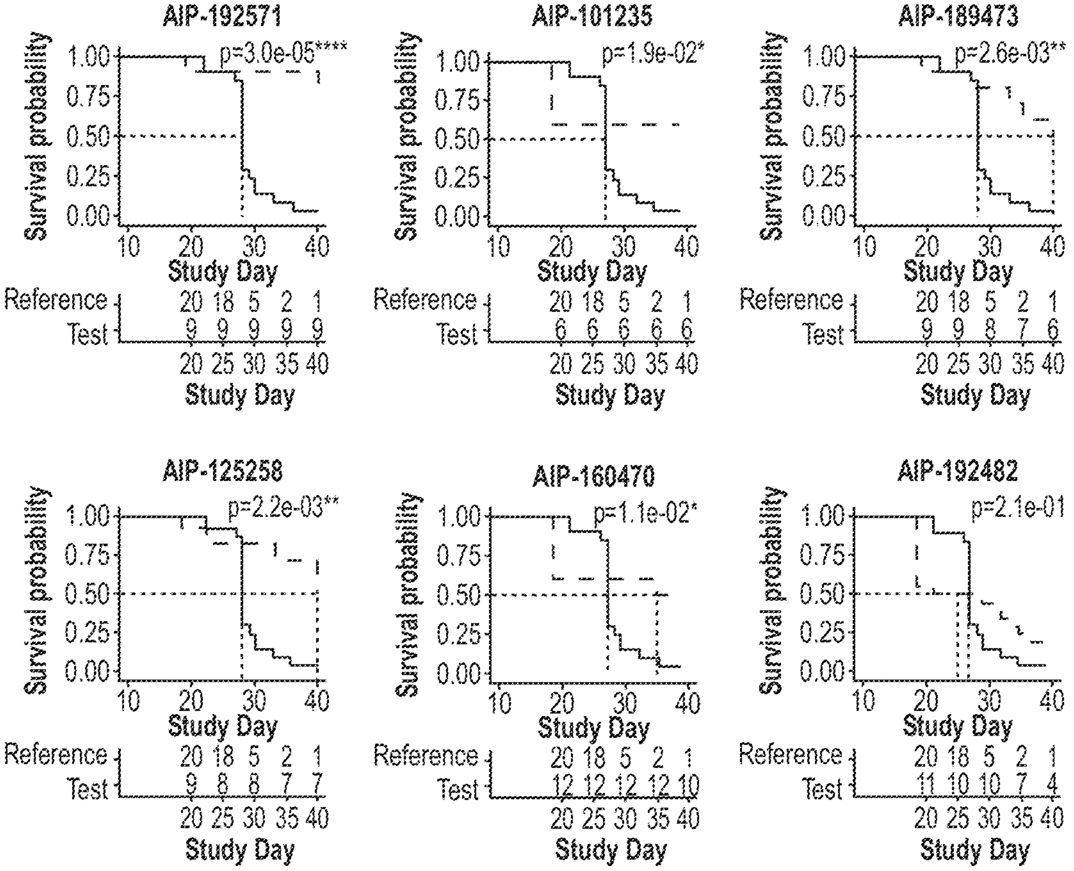
FIG. 44 shows the anti-tumor effects of variants in Round 2, ranked by median Survival.
Figure 45:
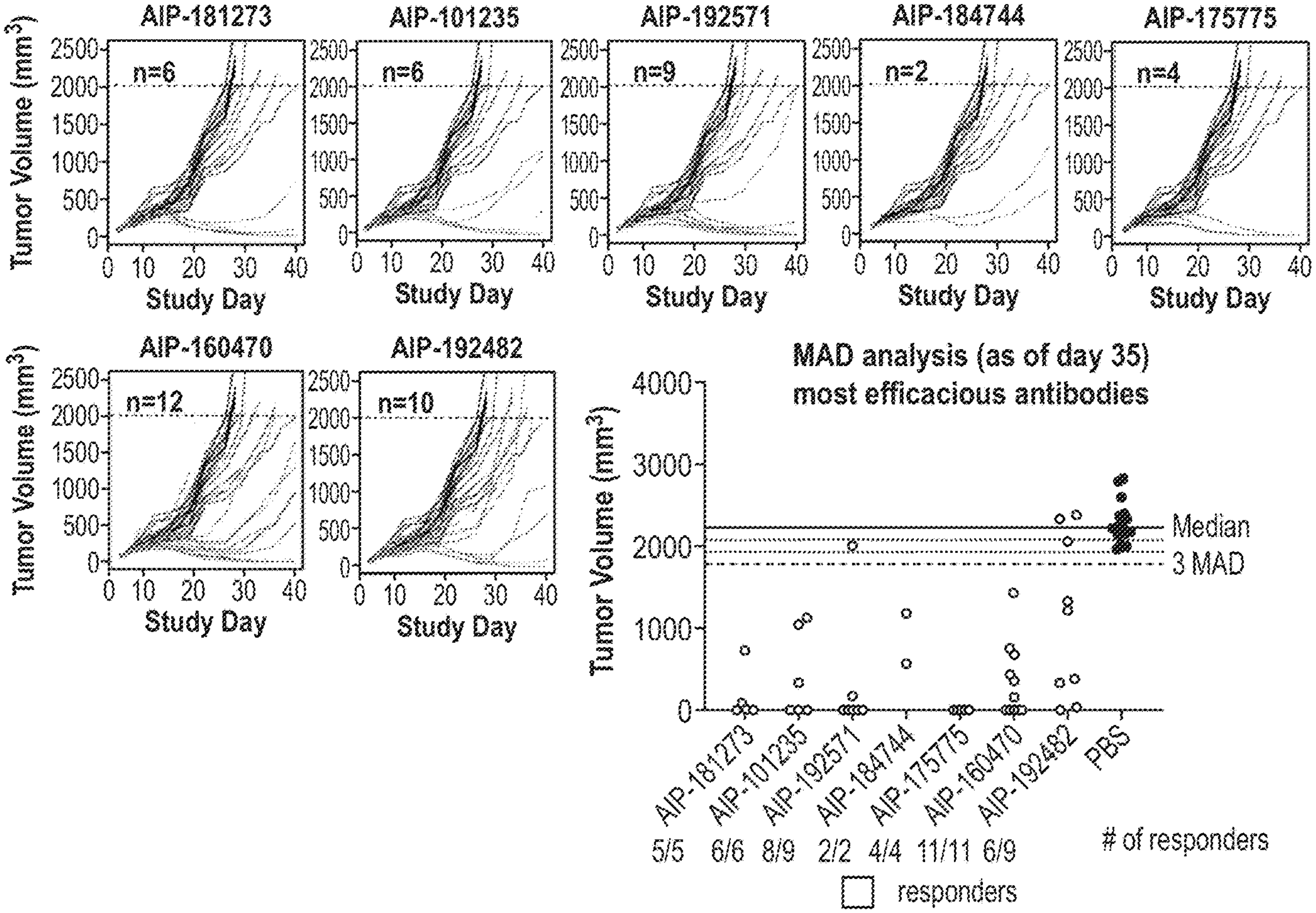
FIG. 45 shows antibodies that exhibited the most efficacious responses in Round 2, as ranked by NAAC effect size.
Figure 46:
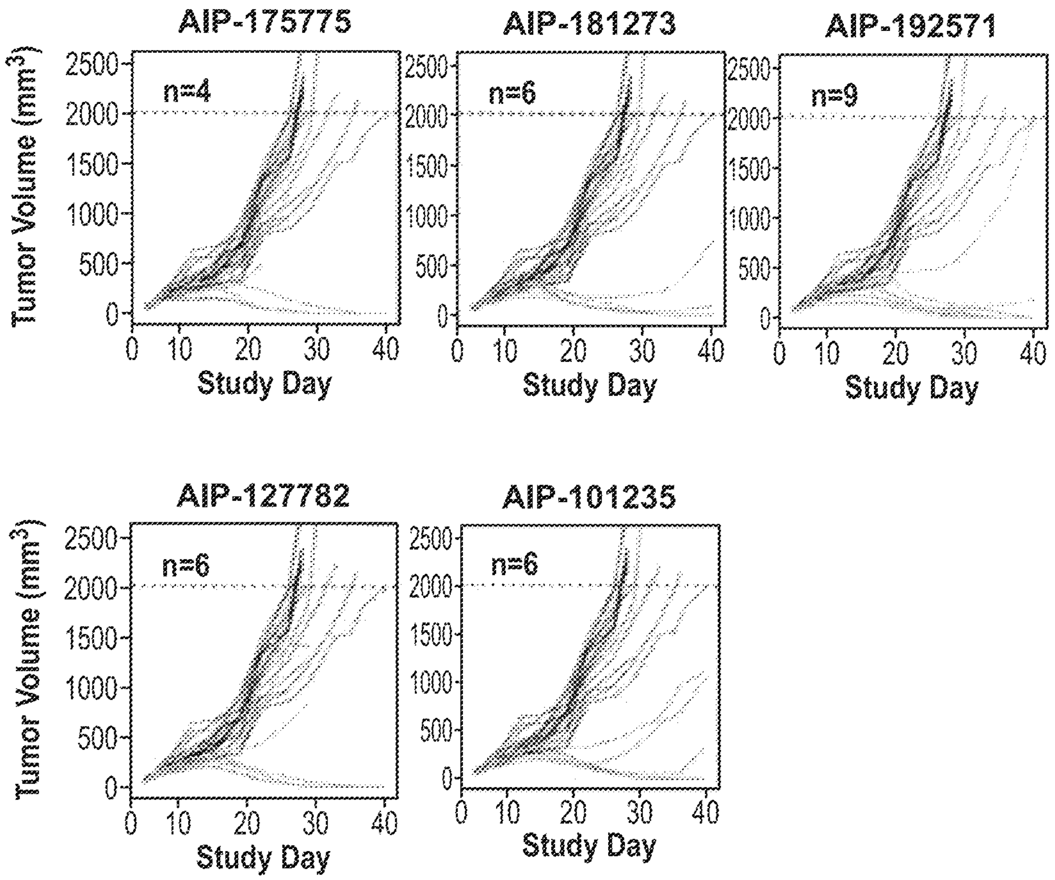
FIG. 46 shows antibodies that exhibited the most efficacious responses in Round 2, ranked by NGRM effect size.
Figure 47:
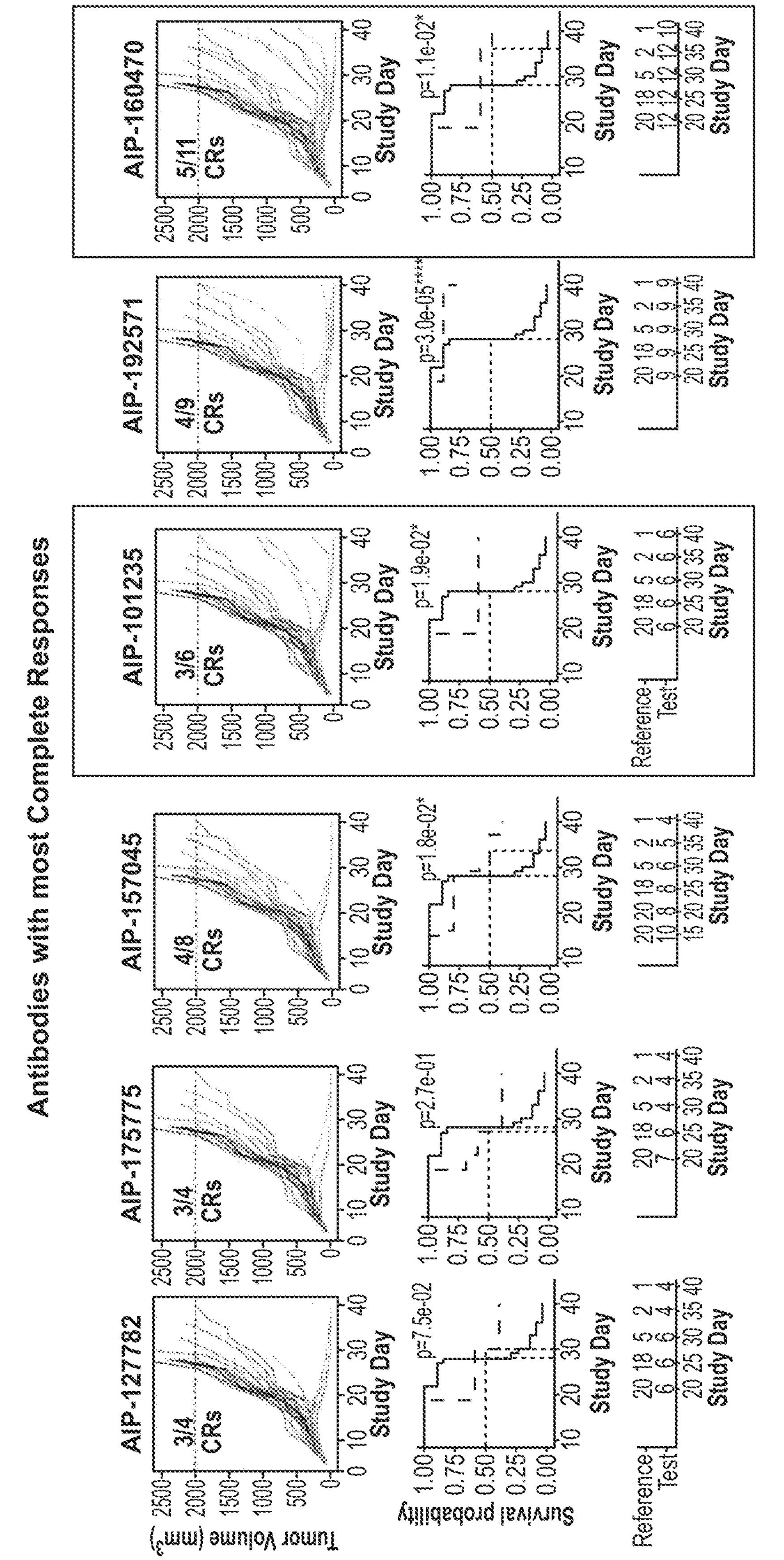
FIG. 47 shows antibodies that elicited the most complete responses in Round 2.
Figure 48:
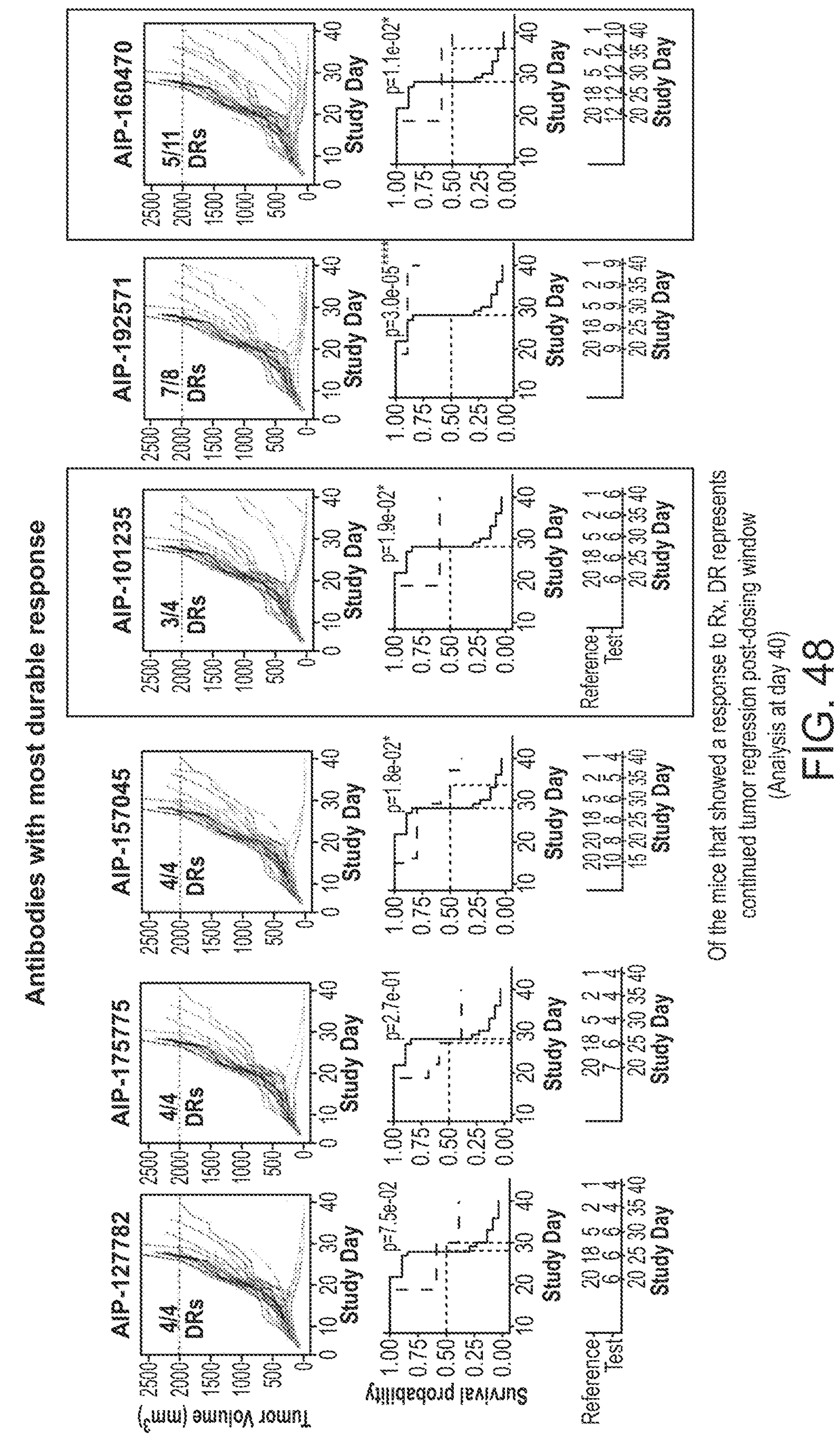
FIG. 48 shows antibodies that exhibited the most durable responses in Round 2

A subset of variants of that were active in vitro were selected to evaluate anti-tumor activity in vivo using the EMT6 mouse model. Two rounds of in vivo studies were performed. Round 1 included AIP-192482, AIP-160470, and 16 other variants. Round 2 included AIP-192482, AIP-160470, a repeated variant from round 1 (AIP-101235), and 16 additional variants generated as described herein. Thus, the in vivo studies as described in this application comprised 34 unique antibodies, with 3 of those 34 antibodies tested in both rounds. The variants tested in vivo in Rounds 1 and 2 are described in FIGS. 40 and 41, respectively, which include the $EC_{50}$ values and A activity rankings. Anti-tumor activity in vivo was assessed using Survival, a normalized area above the curve metric (NAAC), and a normalized growth rate metric (NGRM), where NAAC and NGRM were both developed at Atreca. A description of these assays is provided below in the "Detailed Methodology" section. As explained in the Methodology section, "in vivo active" based on the in vivo activity was assessed by a p-value ≤0.05 in at least one of the analyses of survival, NAAC, and NGRM, i.e., if an antibody exhibited a p-value of less than or equal to 0.05 for survival, NAAC, and/or NGRM (any one alone being sufficient), the antibody is considered "in vivo active". The study design is shown in FIG. 42. FIG. 43 provides data showing the tumor volume across cohorts at randomization in Round 2. FIG. 44 shows the anti-tumor effects of variants in Round 2, ranked by median Survival. FIG. 45 shows antibodies that exhibited the most efficacious responses in Round 2, as ranked by NAAC effect size. FIG. 46 shows antibodies that exhibited the most efficacious responses in Round 2, ranked by NGRM effect size. FIG. 47 shows antibodies that elicited the most complete responses in Round 2. "Complete Response" (CR) is when three consecutive tumor volume measurements (TVMs) are recorded as 0 $mm^3$ (analysis at day 40)". Antibodies that elicited the most complete responses refers to antibodies that elicited the most animals in the group as a complete response, e.g., if there were 6 mice in the group, and 3 of the 6 mice were a CR, then that antibody elicited 3 CRs, and the figure is showing the antibodies with the highest value of # of CRs. Data for antibodies that exhibited the most durable responses in Round 2 are provided in FIG. 48. "Durable Response" (DR) as defined in FIG. 48 represents continued tumor regression post-dosing window (Analysis at day 40). A summary of the in vivo activity of a subset of variant antibodies having anti-tumor effects is provided in FIG. 49.

Figure 50A:
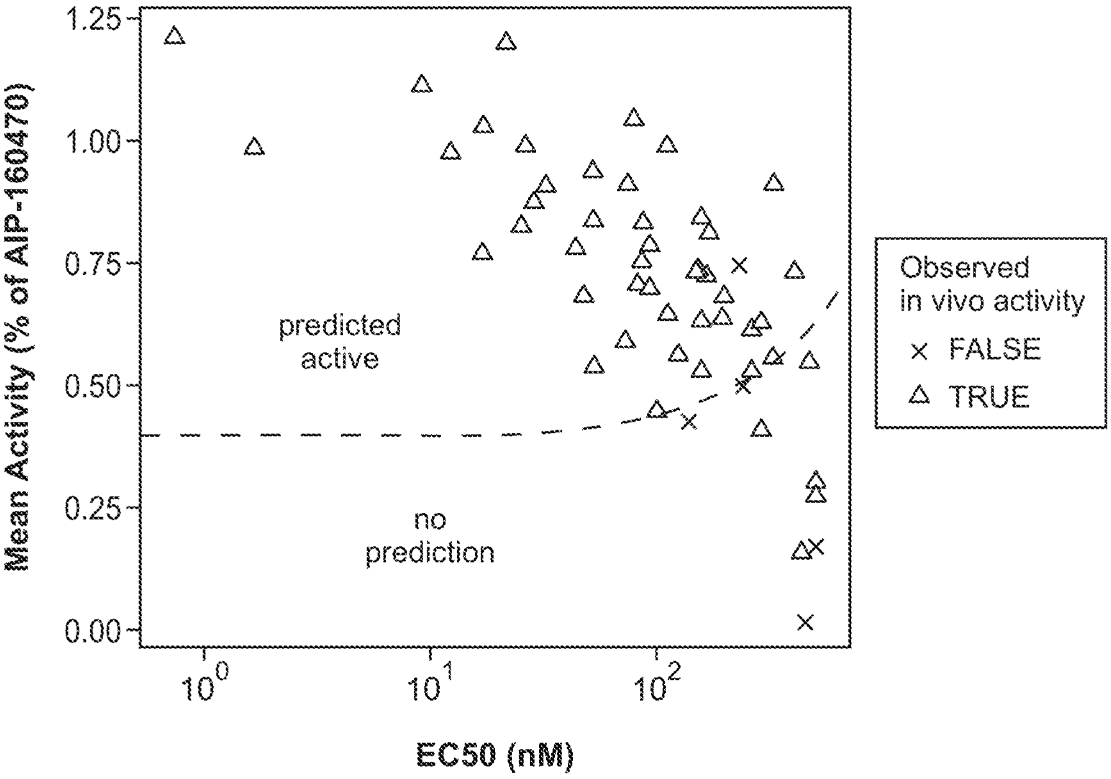
FIGS. 50A and 50 B show the relationship between in vitro Fc-gamma receptor assay results and in vivo activity
Figure 50B:
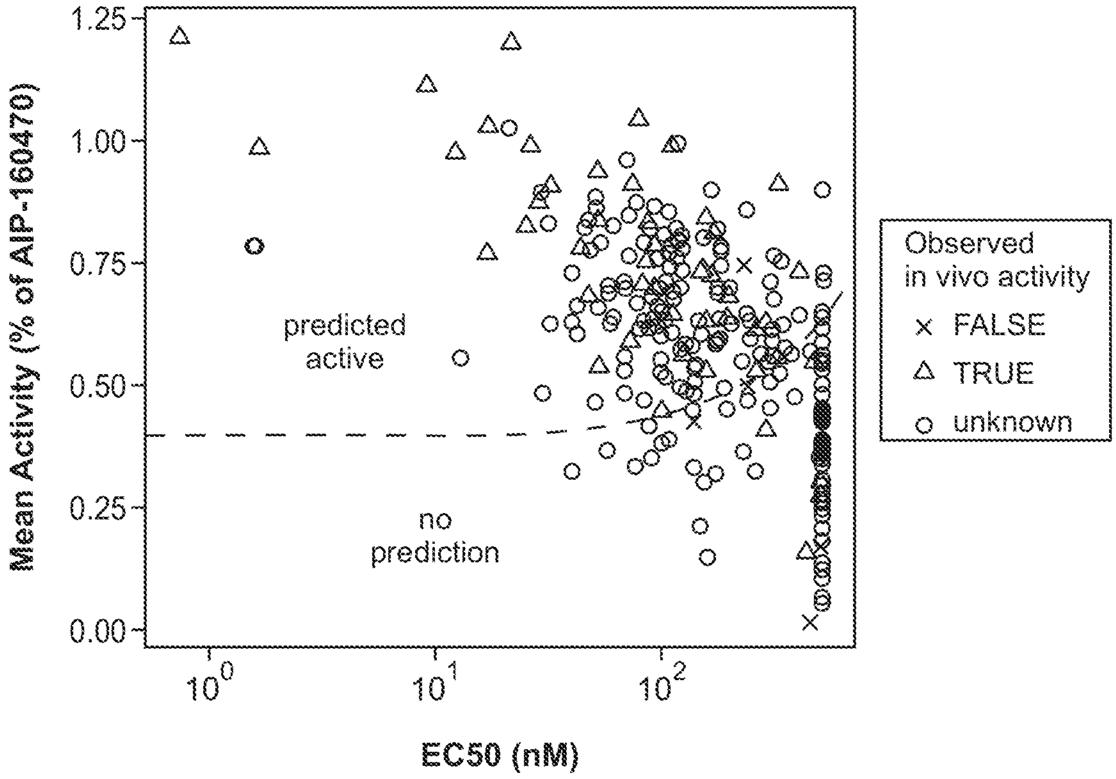

The relationship between activity in the in vitro FcγRIIa assay in vivo activity and in vivo anti-tumor activity was investigated to determine if the in vitro assay predicted in vivo activity. To model the relationship between in vitro Fc-gamma receptor assay results and in vivo activity, a multiple logistic regression model with linear terms was constructed using R version 3.4.3 (The R Foundation). The model was trained on a subset of data including AIP-192482, AIP-186435, AIP-172643, AIP-172872, and AIP-114111, which results in only one false positive (AIP-163039) of all antibodies with no observed in vivo activity. For each antibody, both the $EC_{50}$ (nM) and delta activity were averaged over multiple runs, delta activity was normalized to AIP-160470, and the in vivo activity was assessed by a p-value≤0.05 in at least one of the analyses of survival, NAAC, and NGRM. The results are shown in FIGS. 50A and 50B. The analysis indicates that an antibody with in vitro $EC_{50}$ and normalized delta activity over the threshold line shown in the two FIGS. is generally predictive of exhibiting anti-tumor activity in vivo.

Engineered FRs

The $V_H$ and $V_L$ sequences of AIP-160470 were also engineered to contain the framework regions from a different IGHV or IGLV gene. Framework regions are those between the defined CDR residues. The FR regions of the $V_H$ of AIP 160470 correspond most closely to IGHV3-15, IMGT ID $X_{92216}$ and the FR regions of the $V_L$ of AIP 160470 correspond most closely to IGLV1-47, IMGT ID Z73663.

AIP-127782 has the CDRs of AIP-160470 and was engineered to have $V_H$ FRs of IGHV3-72 (IMGT ID $X_{92206}$) and $V_L$ FRs of IGLV1-51 (IMGT ID Z73661). AIP-127782 was active in the in vitro engagement assay. Anti-tumor activity was also evaluated in vivo (below). This antibody also exhibited anti-tumor activity in the EMT6 mouse model.

Three additional antibodies were generated. AIP-180422 has the CDRs of AIP-160470, $V_H$ FRs of IGHV3-72 (IMGT ID $X_{92206}$) and $V_L$ FRs of native IGLV1-47 (IMGT ID Z73663). AIP-166722 has the CDRS of AIP-160470, $V_H$ FRs of IGHV3-72 (IMGT ID $X_{92206}$), and $V_L$ FRs of IGLV1-40 (IMGT ID M94116). AIP-193490 has the CDRs of AIP-160470, $V_H$ FRs of IGHV3-49 (IMGT ID M99401); and $V_L$ FRs of IGLV1-40 (IMGT ID M94116). These antibodies all exhibited activity in the in vitro engagement assay. These antibodies were not tested in vivo.

Detailed Methodology

EMT6 Syngeneic Mouse Tumor Model, In Vivo Evaluation of Anti-Tumor Activity

An EMT6 syngeneic mouse tumor model was used as described above to assess the anti-tumor efficacy of mIgG2a chimeric variants of ATRC-101. The procedure utilized is modified from DeFalco et al., *Clin. Immunol.* 187:37-45, 2018. EMT6 mouse tumor cells were propagated in culture by passaging cells every 2 to 3 days (1:10 subcultures). On the day of inoculation, cells were collected, counted, and diluted to $5\times10^6$ cells/mL in Waymouth's medium without supplements. Cell viability was tested immediately prior to and following inoculation. Female 4-6-week old BALB/c mice were each inoculated in the right hind flank by subcutaneous injection with $1\times10^6$EMT6 cells in 0.2 mL Waymouth's media without supplements. The day of cell inoculation was designated as Study Day 0. An overage of >30% was included to achieve study groups with consistent and homogenous tumor volumes. Mouse tumors consistently became visible and palpable approximately three days after cell inoculation. Tumor volumes were measured 2-3 times prior to randomization. Mice were randomized on study day 7 using the 'matched distribution' randomization function of the StudyLog lab animal management software (version 3.1.399.23) to ensure homogenous tumor volumes. Mice with pre-ulcerated tumors, irregular shaped tumors, or multiple tumors were excluded from randomization. Test articles and vehicle control were prepared in formulation buffer (Dulbecco's PBS, DPBS). Diluted antibody was aliquoted in sterile, pre-sealed, single-dose borosilicate glass vials and kept at 4° C. until dosing. Starting on randomization day, test articles were dosed at 10 ml/kg based on mouse body weight via twice weekly IP injection for a total of 7 doses. All mice were dosed as scheduled or until they were removed from study based on the euthanasia criteria defined and in compliance with end points according to animal use protocol EB17-010-104 at Explora BioLabs. Tumor volumes were measured twice weekly after randomization using electronic calipers connected to the StudyLog lab animal management software (version 3.1.399.23). Tumor volumes were calculated automatically using the following equation:

$$\text{Tumor Volume } (mm^3)=\text{length } (mm)\times\text{width}^2\ (mm)\times 0.5$$

Following test article administration, mice with tumor volumes of 0 $mm^3$ for three consecutive measurements were considered to show a complete response (CR). Mice with consistent tumor regression that continued after closure of the dosing window were considered to show a durable response (DR).

Mice were terminated when any of the following endpoints, approved by the IACUC protocol, were observed: Tumor volume of greater than ≥2000 $mm^3$, tumor prevents normal animal function (posture, gait, ability to eat or drink, respiration, etc.), or extensive tumor ulceration (>50% of the area of the tumor; or if evidence is demonstrated that ulcerated tumors cause chronic pain)

Statistical analyses of tumor volumes were performed using the normalized area above the curve (NAAC) and the normalized growth rate metric (NGRM) developed at Atreca, Inc.

To determine the NAAC, the area between the tumor volume curve and the tumor volume endpoint of 2000 $mm^3$ was divided by the total area possible through Study Day 35 post tumor inoculation. The total area possible is determined between the first time point at which all animals have a measurable tumor volume and Study Day 35 for tumor volumes between 0 $mm^3$ to 2000 $mm^3$. NAAC values are between 0 and 1. Individuals with a small area between the curve and the tumor volume endpoint have NAAC values closer to 0, and individuals with a larger area between the curve and the tumor volume endpoint have NAAC values closer to 1.

To determine the NGRM, the slope was first calculated for the log-transformed tumor volumes versus time, and then rescaled to 20 days post tumor inoculation. These slopes were then normalized to values between 0 and 1. Individuals with an increasing tumor volume over time have NGRM values closer to 0, and individuals with a stable or decreasing tumor volume over time have NGRM values closer to 1.

Statistically significant differences between the distributions for the treatment and control group were evaluated for NAAC and NGRM with a one-sided Wilcoxon rank-sum test, yielding ap-value using R version 3.4.3 (The R Foundation). Animals with final tumor volumes that did not reach 1800 $mm^3$ and did not survive through 80% of the duration of the analysis were excluded from the analysis of NAAC and NGRM.

An analysis of survival was performed using the study endpoint data. Survival curves for each group were estimated with the Kaplan-Meier method. Statistical analyses were performed using a one-sided log-rank test to assess the survival advantage of a test group relative to the PBS control using R version 3.4.3 (The R Foundation). The model predicted that an antibody designated herein as AIP-192482, AIP-171142, AIP-165430, AIP-189526, AIP-122563, AIP-158623, AIP-155066, AIP-166120, AIP-133645, AIP-187893, AIP-142079, AIP-160470, AIP-102396, AIP-150055, AIP-167084, AIP-185304, AIP-134770, AIP-141887, AIP-196203, AIP-128195, AIP-116579, AIP-192329, AIP-197809, AIP-142489, AIP-167726, AIP-199834, AIP-143179, AIP-195587, AIP-153462, AIP-115363, AIP-151090, AIP-168083, AIP-161082, AIP-114196, AIP-189338, AIP-183190, AIP-110143, AIP-147176, AIP-134312, AIP-128243, AIP-156172, AIP-147389, AIP-124314, AIP-185291, AIP-135247, AIP-113513, AIP-102299, AIP-179097, AIP-109343, AIP-119622, AIP-191735, AIP-157078, AIP-153475, AIP-133650, AIP-190915, AIP-167400, AIP-109729, AIP-151709, AIP-136628, AIP-101601, AIP-146871, AIP-170053, AIP-199483, AIP-162041, AIP-180675, AIP-183133, AIP-191470, AIP-151167, AIP-106633, AIP-102624, AIP-109484, AIP-126080, AIP-161571, AIP-163039, AIP-101235, AIP-182061, AIP-181246, AIP-192216, AIP-171912, AIP-172872, AIP-167833, AIP-190051, AIP-145518, AIP-167533, AIP-112580, AIP-143155, AIP-119664, AIP-190526, AIP-114403, AIP-156760, AIP-103803, AIP-195588, AIP-145722, AIP-178251, AIP-116142, AIP-183350, AIP-127108, AIP-128147, AIP-109510, AIP-104086, AIP-143132, AIP-170105, AIP-169636, AIP-152243, AIP-138776, AIP-103817, AIP-130491, AIP-188155, AIP-167246, AIP-106139, AIP-198351, AIP-159326, AIP-192275, AIP-190761, AIP-166832, AIP-148062, AIP-129145, AIP-111240, AIP-153888, AIP-130915, AIP-109048, AIP-170569, AIP-154873, AIP-159037, AIP-186826, AIP-156514, AIP-157122, AIP-173276, AIP-150485, AIP-166847, AIP-124013, AIP-126285, AIP-168605, AIP-190274, AIP-136060, AIP-180422, AIP-166722, AIP-127782, AIP-189473, AIP-192571, AIP-112328, AIP-125258, AIP-150199, AIP-125062, AIP-177193, AIP-115388, AIP-107759, AIP-170221, AIP-143369, AIP-189475, AIP-102833, AIP-157045, AIP-175775, AIP-154181, AIP-125984, AIP-160829, AIP-184744, AIP-128136, AIP-181273, AIP-153125, or AIP-131972 will have anti-tumor activity.

FcγRIIa Engagement Assay Using EMT6 Tumor Cells

The target of the anti-tumor antibodies as described herein are expressed by tumor cells when they are grown in vivo, but not expressed by tumor cells grown under standard culture conditions in vitro. The assay is performed on cells ex vivo, i.e., tumor cells that were grown as a tumor graft in a syngeneic (immune matched) mouse in vivo then harvested and processed within 24-48 hrs.

The assay has four parts: A. Preparation of stock EMT6 mouse breast cancer cells in vitro; Inoculation and growth of EMT6 tumors in Balb/c mice in vivo; C. Harvest of EMT6 tumor cells and preparation of ex vivo cell bank; Use of ex vivo EMT6 cells for the FcγR2a engagement assay. The protocol for each step is provided below.

A. Preparation of EMT6 Mouse Breast Cancer Cells In Vitro

1. Remove vial of EMT6 cells from liquid nitrogen
2. Thaw in 37° C. water bath until almost completely thawed (small chunk of ice should remain)
3. Add thawed cell suspension (1 ml) to 9 ml of EMT6 cell culture media in 50 ml tube
4. Spin, 300×g, room temperature, 5 min
5. Aspirate supernatant and re-suspend cells in 15 ml EMT6 media
6. Add cell suspension to T75 TC-treated cell culture flask
7. Grow cells in a humidified incubator at 37° C. with 5% CO2
8. Supply fresh media on Monday, Wednesday, and Friday
9. Expand cells when they reach 80% confluency
   a. Aspirate cell culture media from flask
   b. Wash once with 10 ml PBS w/o $Ca^{2+}$ $Mg^{2+}$
   c. Add 2 ml TrypLE (#12604021, Invitrogen)
   d. Incubate for 5 min at 37° C.
   e. Gently tap flask to detach cells (confirm under microscope)
   f. Add 7 ml NGM to dish, gently pipette up and down to resuspend
   g. Split 1:10 in new flask
   h. Add media. Gently pipette up and down to create homogenous suspension
   i. Grow cells in a humidified incubator at 37° C. with 5% CO2
10. Once cells reach 80% confluency, harvest for frozen aliquots:
11. Detach cells as described above and pool in 50 ml tube
12. Take 10 μl cell suspension and add 10 μl Trypan Blue
13. Mix well and count cells using a Countess II cell counter (#$AMQAX_{1000}$, Fisher Scientific).

Calculate Cell Viability

14. Spin, 300×g, room temperature, 5 min
15. Resuspend in pure FBS at $4\times10^6$ cells/ml
16. Add equal amount of FBS containing 20% DMSO prepared beforehand. (Do not add 100% DMSO directly to cells)
17. Mix well by gently pipetting up and down 18. Aliquot 1 ml ($2\times10^6$ cells) of cell suspension into cryo tubes and freeze in Mr Frosty (51000001, ThermoFisher) at −80° C.
19. Transfer to long-term liquid N2 storage the next day
B. Inoculation and Growth of EMT6 Tumors in Balb/c Mice In Vivo
Thawing EMT6 Cells from Master Bank
1. Thaw 1 vial of EMT6 cells from Section A in a 37° C. water bath. Transfer cells to a 15 ml conical tube. Add 10 ml of normal growth media. Centrifuge at 300×g, room temperature, 5 minutes. Aspirate supernatant. Resuspend cell pellet in 15 ml NGM and seed in T75 flask
2. On day 2, passage cells from T75 into T225 using the above described method for passaging cells
3. On day 4, passage cells 1:10 (1:12 if over the weekend)
4. On day 6 or 7, passage cells 1:10 (1:12 if over the weekend/if larger amounts of cells are needed, expand at this stage)
5. On day 8 or 9, expand cells into 10 flasks
6. On day 10 or 11, harvest cells for in vivo injection:
EMT6 tumor inoculation
A. Aspirate cell culture media from flask
B. Wash once with 10 ml PBS w/o $Ca^{2+}$ $Mg^{2+}$ (20 ml for T225)
C. Add 2 ml TrypLE (#12604021, Invitrogen) (5 ml for T225)
D. Incubate for 5 min at 37° C.
E. Gently tap flask to detach cells (confirm under microscope)
F. Flush cells off the flask with 7 ml (15 ml for T225) EMT6 media
G. Count cells and determine viability with Trypan Blue
a. Do not proceed if viability is below 85%
H. Spin, 300×g, RT, 5 min
I. Aspirate supernatant
J. Resuspend cells in Waymouth's media without FBS to achieve $5\times10^6$ cells/ml
 a. 1 T225 cell culture flask will yield around 18-24×106 viable cells
K. Keep cells on ice from here on
L. Anaesthetize female, 8 week old BALB/c mice using isoflurane inhalation
M. Shave left flank of BALB/c mice
N. Use 1 ml syringe with 25G needle to inject 200 ul cell suspension (1×106 cells total) subcutaneous
 a. Make sure you don't see reflux of cells back into the syringe
 b. Make sure cell suspension doesn't leak out of injection site
O. Check cell counts and viability after inoculation has been performed
 a. Should be in a 10% window
P. Monitor tumor growth using calipers
C. Harvest EMT6 Tumors and Preparation of Ex Vivo Cell Bank
1. Harvest tumors once they reach 500-800 $mm^3$ as measured with calipers
2. Remove all surrounding skin and muscle
3. Transfer tumors into RPMI media on ice, containing Primocin at 1/500 dilution (100 μg/mL)
4. (Tumors can be pooled and volumes scaled up proportionately)
5. Prepare Tumor Digestion Mix (per 1 tumor)
a. 3.3 ml HBSS w $Ca^{2+}$ $Mg^{2+}$
b. 33 ul Collagenase A (final concentration: 0.2 mg/ml)
c. 33 ul Dispase II (final concentration: 0.8 mg/ml)
d. 17 ul DNase (final concentration: 0.02 mg/ml)
e. 6.6 uL Primocin
f. Mix and filter through 0.22 micron cellulose acetate filter to sterilize
6. Recover tumors from RPMI. Cut tumors into small pieces and add 1 ml digestion mix per tumor
7. Incubate in either FACS tube with cap, 15, or 50 ml screwcap tube at 37° C. continuously rotating
for 15 min
8. Allow cells to settle for 30 seconds
9. Carefully remove supernatant with 1 ml pipette and add to 3 ml of pure FBS on ice, containing
Primocin at concentration of 100 μg/mL
10. Add another 1 ml of digestion mix and repeat 2× for a total of 3×
11. (you can cut the top off a 1 ml pipette tip and use it for mechanical dissociation in between the digestion steps)
12. After the last digestion, the cell suspension should pass through a 1 ml micropipette tip
13. Filter collected cells in FBS through 100 micron cell strainer into a new 50 ml tube
14. Spin, 300×g, 4° C., 10 min
15. Remove supernatant and resuspend cells in 1 ml pure FBS (with Primocin at 100 μg/mL)
16. Count and adjust cells to 6×106 cells/ml with FBS (with Primocin at 100 μg/mL)
a. Due to debris, cell counts with the Countess II or a Hemocytometer can be inaccurate i. Staining of nucleated cells with 1:1000 Draq5 (5 mM stock concentration) and counting on a flow cytometer in the APC channel is recommended
ii. Addition of DAPI at 1:1000 allows for live cell gating of the nucleated population
(Violet laser required)
1. Prepare staining solution by adding 1 μl of Draq5 (5 mM stock) and 1 μl of DAPI to 1 ml of PBS
2. Add 40 μl staining solution to a round bottom 96 well
3. Add 10 μl cell suspension and mix well
4. Incubate for 5 min at room temperature in the dark
5. Analyze sample by flow
a. Gate on Draq5 (APC channel) positive cells first
b. Determine DAPI (BV421 channel) negative cells within the Draq5 positive population
6. If flow cytometer can measure events/μl, you can calculate the cell number directly (Cytflex can do that)
7. If flow cytometer can not measure events/μl (like most BD instruments), you would need to add counting beads to get cell counts
b. Viability should be above 75%
17. Resuspend cells at 4×106 cells/ml with FBS (with Primocin at 100 μg/mL)
18. Add equal amount of FBS containing 20% DMSO and 100 μg/mL Primocin
19. Mix well by pipetting up and down
20. Aliquot 1 ml (2×106 cells) of cell suspension into cryo tubes and freeze in Mr Frosty at −80° C.
a. Expected number of cells ~10×10^6 cells/tumor
21. Transfer to long-term liquid N2 storage the next day
a. Take 1 sample vial and thaw according to the protocol "Thawing of ex vivo cells"
b. Control cell counts
D. Use of Ex Vivo EMT6 Cells for Engagement Assay
Thawing Ex Vivo Cells
1. Thaw a vial in the 37° C. water bath
2. Transfer the contents of the vial to a 50 ml conical tube
3. Add 19 mL of RPMI+2% FBS to the cells drop-by-drop, while swirling the suspension
4. Spin, 300×g, 4° C., 5 min 5. Resuspend in 1 mL PBS+2% FBS+2 mM EDTA
6. Spin, 300×g, 4° C., 5 min
7. Resuspend in 2 mL Assay Buffer (RPMI1640+4% Low IgG Serum)
8. Resuspend in 1 ml Assay Buffer
9. Count and adjust cells to $0.5\times10^6$ cells/ml in Assay Buffer
a. Perform cell count as described in Section C; 16a FcγRIIa Engagement Assay (Promega Kit #G9991)
1. Prepare antibody serial dilutions in Assay Buffer at 1.5× excess.
a. 75 ul total assay volume
b. $10^{-6}$M starting concentration
c. log dilutions in a 6 point dose response curve in triplicates
2. add 25 ul of the antibody dilution to a white, flat bottom 96 well plate.
a. use only inner 60 wells
b. Fill unused wells with 75 ul assay buffer
3. Add 25 ul ex vivo cells to each well containing antibody dilution
a. Gently tap the plate to mix cells with antibody
4. Incubate for 15 minutes at 37° C., 5% CO2.
5. Thaw a vial of FcγRIIa-H Effector cells (0.62 mL) (Promega kit 3G991) in the 37° C. water bath
a. Remove vial from 37° C. as soon as it is thawed
6. Transfer the contents of the vial to a conical tube containing 5.3 mL of Assay Buffer
7. Mix by inverting the tube 4-5 times
8. Count and adjust cells to $0.5\times10^6$ cells/ml
a. Cell counts can be performed using a regular cell counter or hemocytometer
9. Add 25 ul of the FcγRIIa-H effector cells to the opsonized target cells
a. E:T ratio of 1:1
10. Gently shake the plates back and forth to mix the contents (75 ul total volume)
11. Incubate for 5 hours at 37° C., 5% CO2
12. After 5 hours, prepare the Bio-Glo Luciferase solution by adding the whole bottle of Bio-Glo™ Assay Buffer to the Bio-Glo Luciferase Assay substrate (10 mL total per kit).
13. remove plate from incubator
14. Add 75 ul of the Bio-Glo™ mix to each reaction well
15. Incubate at RT in the dark for 15 minutes
16. Measure luminescence in a suitable plate reader
17. Plot curves and calculate EC50 values Reagents and Buffers EMT6 Complete Media (Normal Growth Media, NGM)

Waymouth's MB 752/1 Medium+2 mM L-glutamine+15% fetal bovine serum (FBS)+1% pen/strep Assay Buffer RPMI1640+4% low IgG fetal bovine serum (FBS)

Collagenase A (Sigma-Aldrich, #10103586001)
1. Add HBSS with $Ca^{2+}$ $Mg^{2+}$ to create a stock solution of 50 mg/ml
2. Invert tube multiple times
3. Incubate for 5 min at room temperature
4. Aliquot into 1.5 ml snap-cap tube
5. Store at −20° C. for up to month
6. Avoid repeating freeze/thaw cycles Dispase II (Sigma-Aldrich, #D4693-1G)
1. Reconstitute 1 g of Dispase II in 10 mL molecular biology grade water with 10 mM Sodium Acetate (pH 7.5) and 5 mM Calcium Acetate
2. Invert tube multiple times
3. Incubate for 60 min at room temperature
4. Aliquot into 1.5 ml snap-cap tube
5. Store at 4° C. for up to month DNAse (Sigma-Aldrich, #4536282001)
1. Add HBSS with $Ca^{2+}$ $Mg^{+}$ to create a stock solution of 2 mg/ml
2. Invert tube multiple times
3. Incubate for 5 min at room temperature
4. Aliquot into 1.5 ml snap-cap tube
5. Store at −20° C. for up to 7 days
6. Avoid repeating freeze/thaw cycles

Example 9. Evaluation of Antibody for Cancer Therapy—Overview

An antibody for use in treating cancer was additionally evaluated in the following examples. The antibody is referred to in this example as ATRC-101. It is a fully human immunoglobulin G, subclass 1 (IgG1)/lambda antibody that comprises the $V_H$ and $V_L$ regions of AIP-160470. The amino acid sequences of the heavy and light chains are provided in SEQ ID NOS:1723 and 1724, respectively. ATRC-101 is a sequence variant of an antibody discovered in an antibody repertoire generated by Immune Repertoire Capture® (IRC™) technology from plasmablast B cells isolated from a patient with non-small cell lung cancer (NSCLC) adenocarcinoma. At the time of sample collection, the patient was undergoing treatment, which included, in part, an anti-programmed death receptor 1 (PD-1) monoclonal antibody.

The safety profile of ATRC-101 was established in a series of in vitro cytokine release and tissue cross-reactivity assays as well as a repeat-dose safety study in a syngeneic disease model (female BALB/c mice inoculated with EMT6 tumor cells). A non-Good-Laboratory-Practice (GLP) 4-week repeat-dose toxicity study in cynomolgus monkeys was also conducted to evaluate potential non-target-related toxicity of ATRC-101.

The design of the nonclinical safety package for ATRC-101 reflects the characteristics of the antibody's target and proposed mechanism of action. The ATRC-101 target is a tumor-associated extracellular complex comprising an RNA binding protein and (poly(A) RNA). Although poly(A) RNA and RNA binding proteins such as the polyadenylate binding protein family members are widely expressed across normal human, rhesus monkey, and mouse tissues, ATRC-101 binds preferentially to tumor cells. Tumor-selective binding of ATRC-101 was observed in a variety of human tumor types including NSCLC, breast cancer, CRC, ovarian cancer, and melanoma, where tumor cells were positive, but adjacent tissues were not. Binding to mouse EMT6 tumor cells extracted from tumor tissues is lost over time when these cells are cultured in vitro. In addition, binding of ATRC-101 to human tumor tissues was shown to be dependent on the ribonuclease-sensitive component of the complex. ATRC-101 does not bind to tumor adjacent normal cells, normal cynomolgus monkey tissues, and most normal mouse tissues. Together, these data indicate that the ATRC-101 target is tumor-associated, and that cell-surface localization is dependent on the context of tumor growth in vivo. The tumor-association may be based on misfolding, mis-localization, post-translational modification and/or yet unspecified factors. Therefore, the mouse and cynomolgus monkey are not appropriate species for toxicology testing due to no, or very low, ATRC-101 target expression in normal animal tissues.

Pharmacological evaluations in preclinical models indicate that once ATRC-101 binds to the target expressed on tumor cells, Fc-dependent interaction with innate immune cells shifts the constitution of lymphoid and myeloid cell populations present in the tumor microenvironment from phenotypes associated predominantly with pro-tumorigenic and immune-suppressive activities toward phenotypes associated with anti-tumorigenic and more pro-inflammatory activities. ATRC-101 does not appear to mediate antibody-dependent cell cytotoxicity (ADCC) or complement-dependent cytotoxicity (CDC) in vitro. All available data indicate that binding of ATRC-101 to its target does not trigger or abrogate any signal transduction pathways.

ATRC-101 does not bind to normal human peripheral blood mononuclear cells (PBMCs). Furthermore, ATRC-101 does not induce cytokine release in vitro in either PBMC or whole blood-based assays. Thus, ATRC-101 is considered to pose a low risk of triggering cytokine release in humans.

To support preclinical efficacy and safety studies in mice and pharmacokinetic/toxicokinetic studies in cynomolgus monkeys, sensitive and specific liquid chromatography-tandem mass spectrometry (LC-MS/MS) and enzyme-linked immunosorbent assay (ELISA) methods were developed for the detection of ATRC-101 in mouse and monkey serum, respectively.

The pharmacokinetic profile of ATRC-101 was characterized in a single-dose study and a repeat-dose study in cynomolgus monkeys. Following a single intravenous (IV) bolus administration to cynomolgus monkeys at dose levels of 1, 10, and 30 mg/kg, the time of maximum serum concentration ($T_{max}$) was generally observed between 0.083 and 1 hour post-dose. Half-lives ($T_{1/2}$) ranged from 177 to 225 hours. The apparent clearance rate (CL) and apparent volume of distribution (Vd) ranged between 0.15 and 0.436 mL/hr/kg and 51.4 and 117 mL/kg, respectively. Systemic exposure to ATRC-101 increased with dose within the range tested and the increase was approximately dose proportional. In the 4-week repeat-dose IV toxicity and toxicokinetics study in cynomolgus monkeys, where animals received 4 weekly doses of ATRC-101 by IV administration on Days 1, 8, 15 and 22, $T_{max}$ was generally observed at 0.75 hours post start of infusion (SOI). The terminal elimination phase was not characterized for any animals due to the relatively sustained concentrations observed after $T_{max}$. Systemic exposure increased with dose within the range tested and the increase was approximately dose proportional. There was no notable gender-related difference in exposure. Following repeated administration, systemic exposure on Day 22 was generally higher compared to Day 1, with individual accumulation ratios ranging from 1.64 to 2.17.

The safety of ATRC-101 and the MFC-042 chimera (harboring an identical human Fv region of ATRC-101 but expressed with a mouse IgG2a Fc region; also referred to as AIP-160470-mIgG2a) was evaluated in the EMT6-BALB/c syngeneic breast cancer model. The following safety parameters were evaluated in this study: mortality/moribundity, clinical signs, body weights, clinical pathology (hematology and clinical chemistry), serum cytokine evaluation, serum test article concentrations, gross necropsy findings, organ weights, and histopathologic examinations (9 organs plus tumor tissue in tumor-bearing animals). Repeat-dose intraperitoneal (IP) administration of MFC-042 at dose levels of 0, 0.1, 0.3, 1, 3, 10 and 30 mg/kg or ATRC-101 at dose levels of 0, 1, 10 and 30 mg/kg, to naïve and EMT6 syngeneic breast cancer tumor-bearing female BALB/c mice was well-tolerated and no toxicologically significant effects were noted in any of the parameters examined. Based on these safety assessment results, the no-adverse-effect-level (NOAEL) was considered to be 30 mg/kg for MFC-042 and ATRC-101 in naïve and EMT6 syngeneic breast cancer tumor-bearing female BALB/c mice.

A non-GLP 4-week toxicity study in cynomolgus monkeys was conducted to evaluate the potential non-target related toxicity of ATRC-101. In this study, the following parameters were evaluated in this study: mortality/moribundity, clinical signs, qualitative food consumption, body weights, clinical pathology (hematology, clinical chemistry, and urinalysis), cytokines, TK parameters, organ weights, macroscopic and microscopic examinations (20 organs/tissues, including the brain, heart, lung, liver, kidney, and pancreas). Administration of ATRC-101 by intravenous (IV) infusion once weekly for 4 weeks was well tolerated in cynomolgus monkeys at all dose levels administered: 10, 30, and 100 mg/kg/week. The NOAEL was considered to be 100 mg/kg/week, with associated maximum observed concentration ($C_{max}$) values of 2410 μg/mL for males and 2690 μg/mL for females, and area under the concentration time curve from time zero to time of last measurement ($AUC_{0-t}$) values of 185000 μg·hr/mL for males and 186000 μg·hr/mL for females on Day 22 (528 days).

ATRC-101 and chimeric ATRC-101 variants demonstrate anti-tumor activity in several syngeneic mouse tumor models. Anti-tumor activity of ATRC-101 is enhanced in combination with a PD-1 inhibitor.

There was no clinical evidence of irritation or local tolerance issues at ATRC-101 injection sites after repeat dosing (once weekly for 4 doses total) at doses up to 100 mg/kg (concentration: 20 mg/mL) in cynomolgus monkeys.

In the GLP tissue cross-reactivity study in normal human tissues, staining with ATRC-101 was observed in some human tissues. However, virtually all of the staining was cytoplasmic in nature and therefore is not considered a toxicological concern because it is unlikely that ATRC-101 will cross cell membranes or interact directly with components of the cytoplasm.

Figure 51:
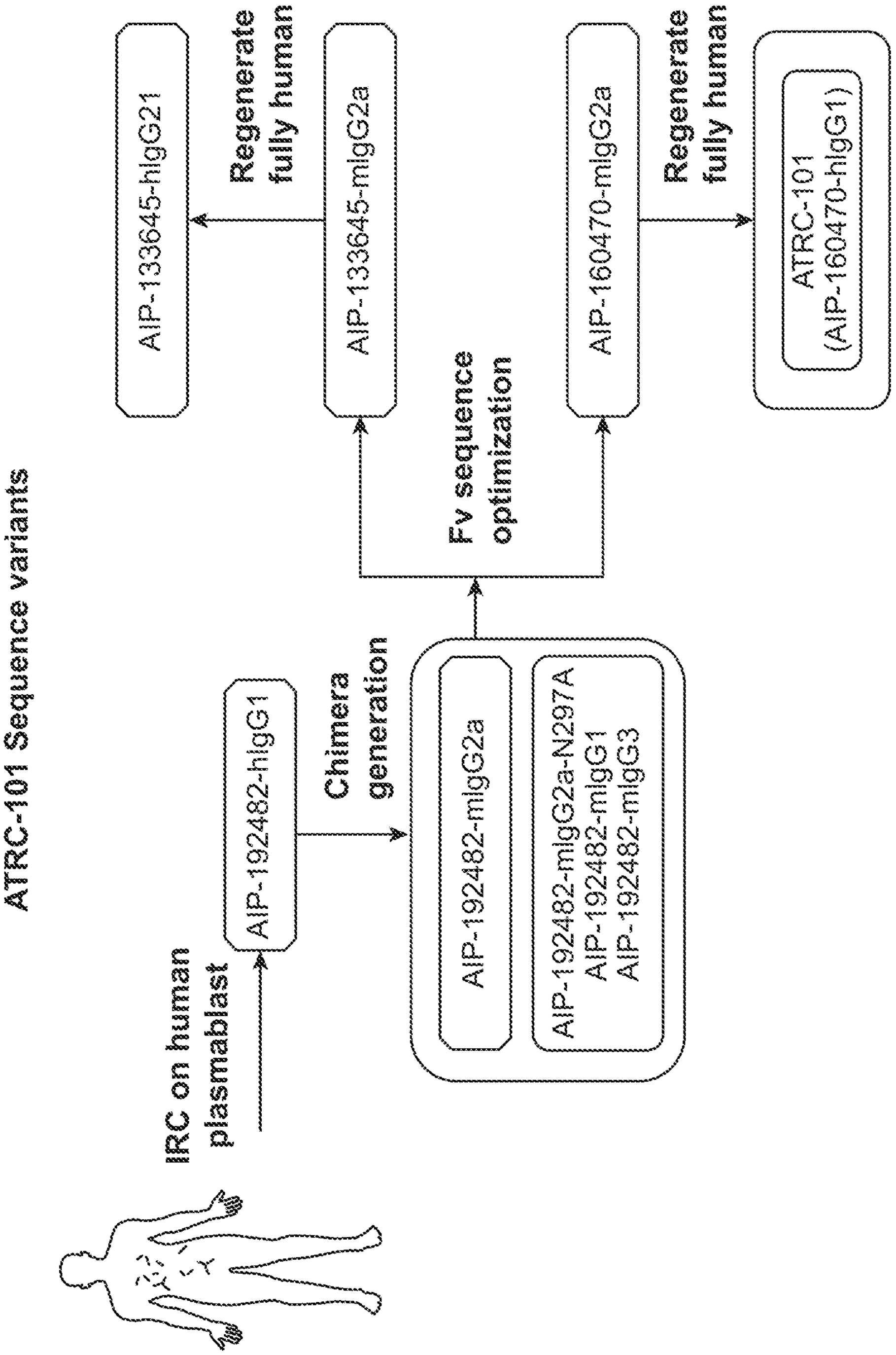
FIG. 51 shows a schematic of the ATRC-101 sequence variants generated during discovery and for pharmacological evaluation of ATRC-101. Numbers are AIP numbers indicating the Fv variants: 192482=AIP-192482, 133645=AIP-133645, 160470=AIP-160470. Fc=fragment crystallizable; Fv=variable fragment; hIgG1=human immunoglobulin G, subclass 1; IRC™=Immune Repertoire Capture®; mIgG1=mouse immunoglobulin G, subclass 1; mIgG2a=mouse immunoglobulin G, subclass 2a, mIgG3=mouse immunoglobulin G, subclass 3; N297A=asparagine to alanine modification at position 297. ATRC-101 is a fully human immunoglobulin G, subclass 1 (IgG1)/lambda antibody that comprises the $V_H$ and $V_L$ regions of AIP-160470.

The pharmacological evaluation of ATRC-101 was carried out using the clinical candidate ATRC-101 as well as sequence variants of ATRC-101 expressed with human or mouse Fc regions based on study objectives and available animal models/assays. An overview of the relationship between ATRC-101 and the sequence variants is shown in FIG. 51.

The following Examples provide further details of the studies summarized above

Example 10. ATRC-101 Target Expression in Tumor Tissues and Cell Lines

Chromogenic IHC, immunofluorescence microscopy, and flow cytometry were used to evaluate ATRC-101 target expression (defined herein by reactivity to a binding antibody) in (i) multiple human tumor tissues, (ii) mouse tumor tissues, and (iii) human and mouse tumor cell lines.

Figure 52:
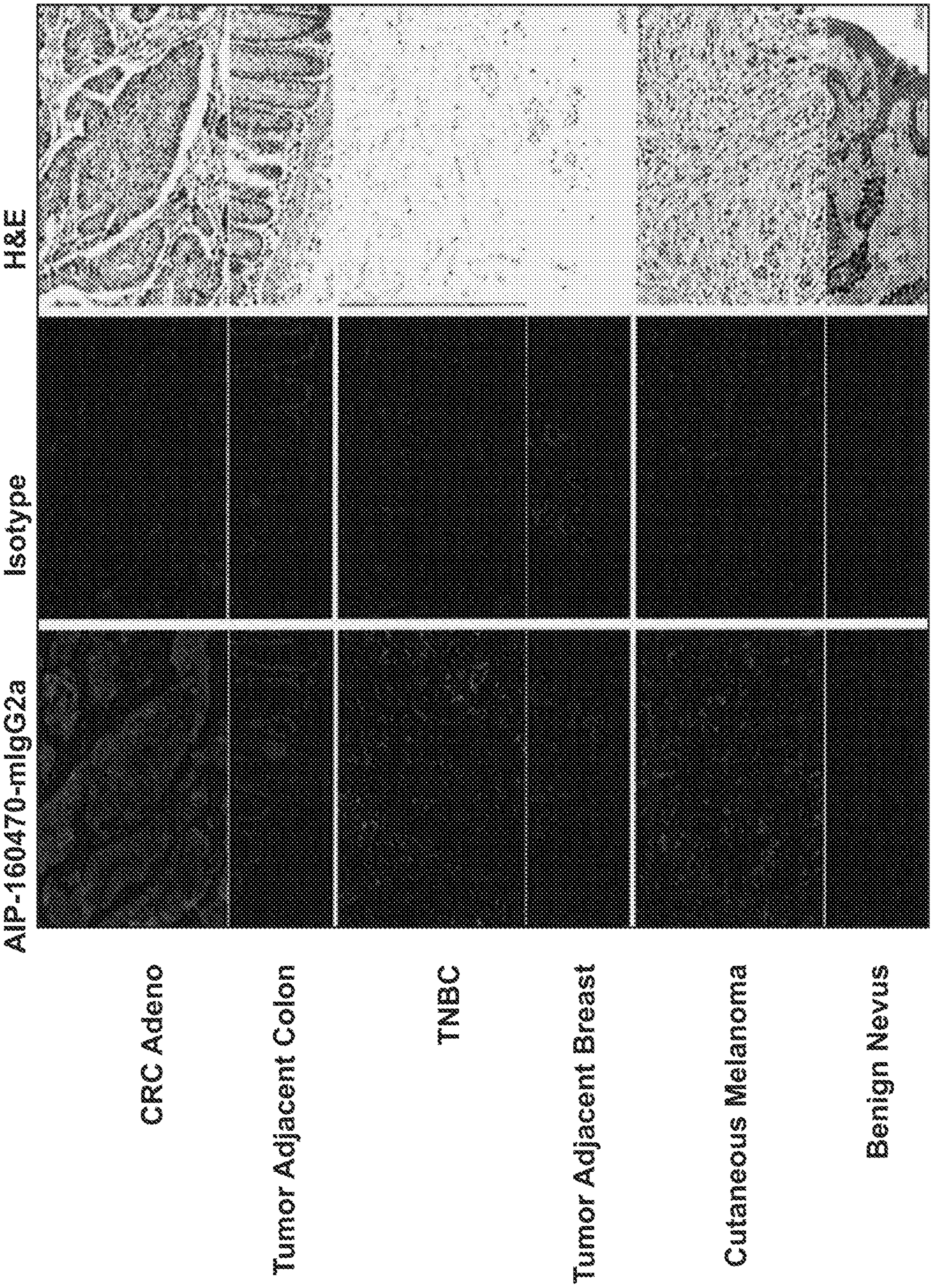
FIG. 52 shows results of expression analysis of ATRC-101 binding on colorectal Cancer, Triple Negative Breast Cancer, and Melanoma by Immunofluorescence. The binding of the chimeric antibody AIP-160470-mIgG2a to formalin-fixed paraffin-embedded tumor and tumor adjacent tissue from CRC, TNBC, and melanoma. Binding was assessed using 10 μg/mL Alexa Fluor 647-conjugated AIP-160470 mIgG2a by standard immunofluorescence methodology and compared to Alexa Fluor 647-conjugated mIgG2a isotype control monoclonal antibody. Tissues were counterstained with Hoechst. Signals detected by AIP-160470-mIgG2a or isotype are shown in red/magenta and nuclei are labeled in blue. H&E staining from an adjacent section is shown. Red line in H&E staining indicates 50 μm. Adeno=adenocarcinoma; CRC=colorectal cancer; H&E=hematoxylin and eosin; μg=microgram; mIgG2a=mouse immunoglobin G, subclass 2a; TNBC=triple negative breast cancer

In an analysis of a variety of human tumors, AIP-160470-mIgG2a bound in a highly selective manner to CRC, TNBC, and melanoma tumor tissues, but not to adjacent tissues FIG. 52.

The prevalence of target binding was assessed across a set of human tumor cores. Samples were scored as non-reactive if staining was negative or faint and reactive if moderate, positive, or robust. AIP-160470-mIgG2a target binding was present in greater than 50% of tested tumor cores for NSCLC (65%), breast cancer (65%), CRC (57%), and ovarian cancer (58%). Melanoma showed 43% reactivity. Liver cancer showed 19% reactivity. Cancer subtype-specific differences in the proportion of reactive cores were observed.

These studies showed that the target of ATRC-101 was highly expressed in several human tumor tissues, including NSCLC, CRC, TNBC, melanoma, and ovarian cancer. The study data indicate that the ATRC-101 target is tumor-associated, and that cell-surface localization is dependent on the context of tumor growth.

Figure 53:
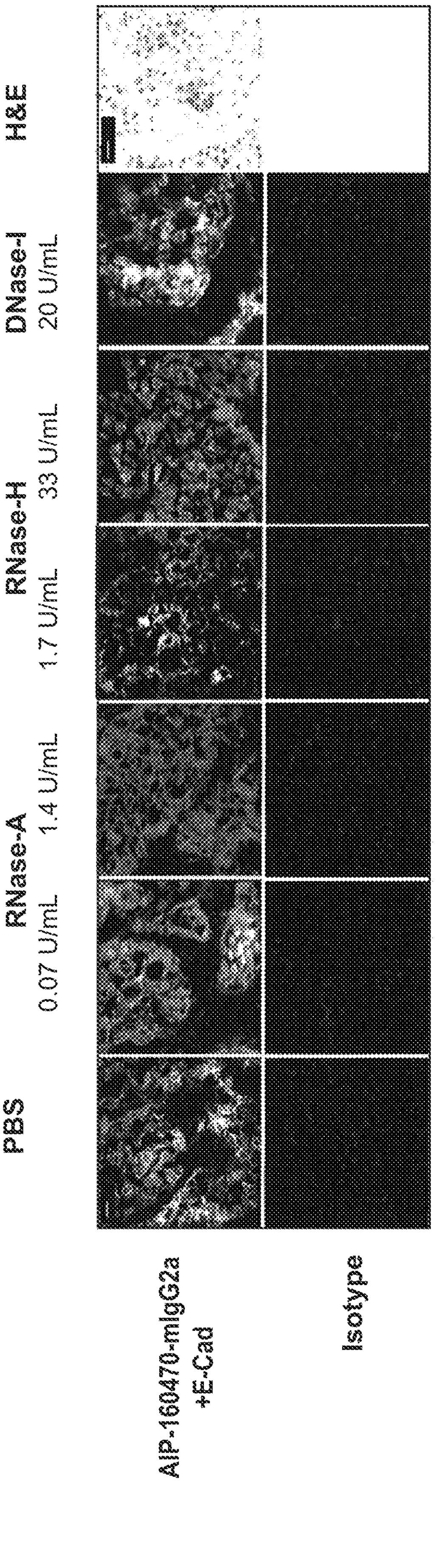
FIG. 53 shows the effect of nuclease pre-treatment on the binding of the chimeric antibody AIP-160470-mIgG2a to human ER+ breast carcinoma tissues. Fresh frozen tissue sections were pretreated with indicated concentrations of RNase A, RNase H, or DNase I. Sections were washed, fixed in paraformaldehyde, and blocked before staining with 20 μg/mL Alexa Fluor 647-conjugated AIP-160470-mIgG2a and anti-E-Cadherin or Alexa Fluor 647-conjugated mIgG2a and rabbit IgG isotype control antibodies. Slides were incubated with Alexa Fluor 488-conjugated secondary anti-rabbit antibody. Sections were washed and counterstained with Hoechst. AIP-160470-mIgG2a is shown as red/magenta, E-Cadherin as shown in green, and yellow indicates co-localization of AIP-160470-mIgG2a and E Cadherin. Nuclei are labeled in blue. Images were captured using a Axio Scan automated slide scanner (Zeiss). H&E staining from an adjacent section is shown. White line in black inset indicates 50 μm. DNase=deoxyribonuclease; E-Cad=E-cadherin; ER+=estrogen receptor positive; H&E=hematoxylin and eosin; μg=microgram; mIgG2a=mouse immunoglobulin G, subclass 2a; mL=milliliter; NSCLC=non-small cell lung cancer; RNase=ribonuclease; U=unit(s).

Immunofluorescence was used to assess whether nuclease digestion of RNA influenced the chimeric antibody AIP-160470-mIgG2a binding to human estrogen receptor positive (ER+) breast cancer. Pre-treatment of fresh frozen tissue sections with RNase A and RNase H abrogated binding of the chimeric antibody AIP-160470-mIgG2a to human ER+ breast cancer in a concentration-dependent manner FIG. 53. In contrast, deoxyribonuclease (DNase) I pre-treatment did not abrogate binding. This data indicates that ATRC-101 target expression, as assessed by immunofluorescence, is dependent on the RNase-sensitive component of the target.

ATRC-101 target expression was evaluated on mouse EMT6 tumor cells that were grown in a syngeneic BALB/c mouse. The chimeric antibody AIP-160470-mIgG2a bound to EMT6-BALB/c syngeneic tumor cores, but not adjacent tissues.

Surface expression of the ATRC-101 target was also assessed by flow cytometry on mouse and human-derived tumor cell lines. The chimeric antibody AIP-160470-mIgG2a bound to mouse ex vivo EMT6-BALB/c syngeneic tumor cells, dissociated, and immediately stained. Binding was not detected when mouse ex vivo EMT6 cells were subsequently cultured in vitro for two or more days prior to staining. When the mouse EMT6 cell lines were only grown in vitro prior to staining and not grown as subcutaneous grafts in BALB/c mice, no binding was observed. Surface binding was also observed to ex vivo Renca, CT26, and LLC1 tumor cells that were grown as subcutaneous grafts in mice prior to staining. No surface binding was observed for 21 human tumor cell lines grown in vitro.

Together, the observations from IHC, immunofluorescence, and flow cytometry indicate that the ATRC-101 target is a tumor-associated complex containing RNA and that the expression of this complex and its surface localization are dependent on how the tumor cells were grown.

Example 11. ATRC-101 Target Expression in Normal Human, Cynomolgus Monkey and Mouse Tissues and Normal Human Blood Cells Chromogenic IHC and immunofluorescence were used to evaluate ATRC-101 target expression (defined herein by reactivity to a binding antibody) in (i) normal human tissues, (ii) normal cynomolgus monkey tissues, and (iii) normal mouse tissues.

Figure 54A:
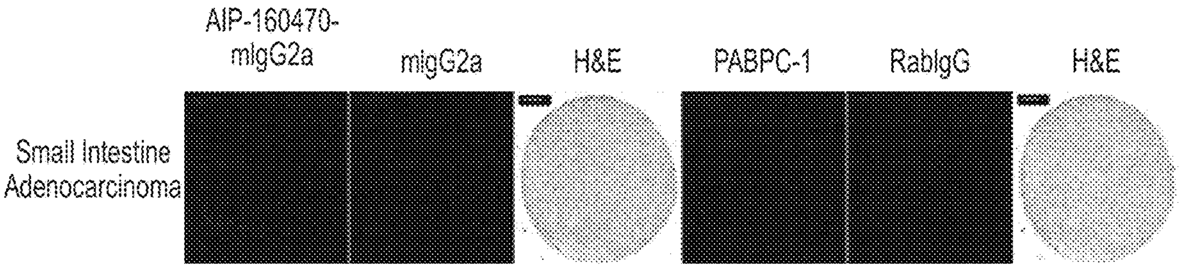
FIGS. 54A and 54B show distribution of chimeric antibody AIP-160470-mIgG2a immunoreactivity and human PABPC-1 in normal tissues and human carcinoma by immunofluorescence. The images show the distribution of chimeric antibody AIP-160470-mIgG2a immunoreactivity in human small intestine adenocarcinoma (FIG. 39A) and representative normal cerebrum, cerebellum, heart, lung, liver, kidney, pancreas, stomach, and spleen tissues from a study of two FFPE TMAs (FDA808J-1 and FDA808J-2.

Specific binding of AIP-160470-mIgG2a was evaluated by immunofluorescence in two formalin-fixed paraffin-embedded (FFPE) tissue microarrays representing 30 normal human tissue types (FDA808J-1 and FDA808J-2). The chimeric antibody AIP-160470-mIgG2a was used to minimize non-specific interactions. Tumor-selective binding was observed in human adenocarcinoma, which was included as a positive control (FIG. 54A).

Figure 54B:
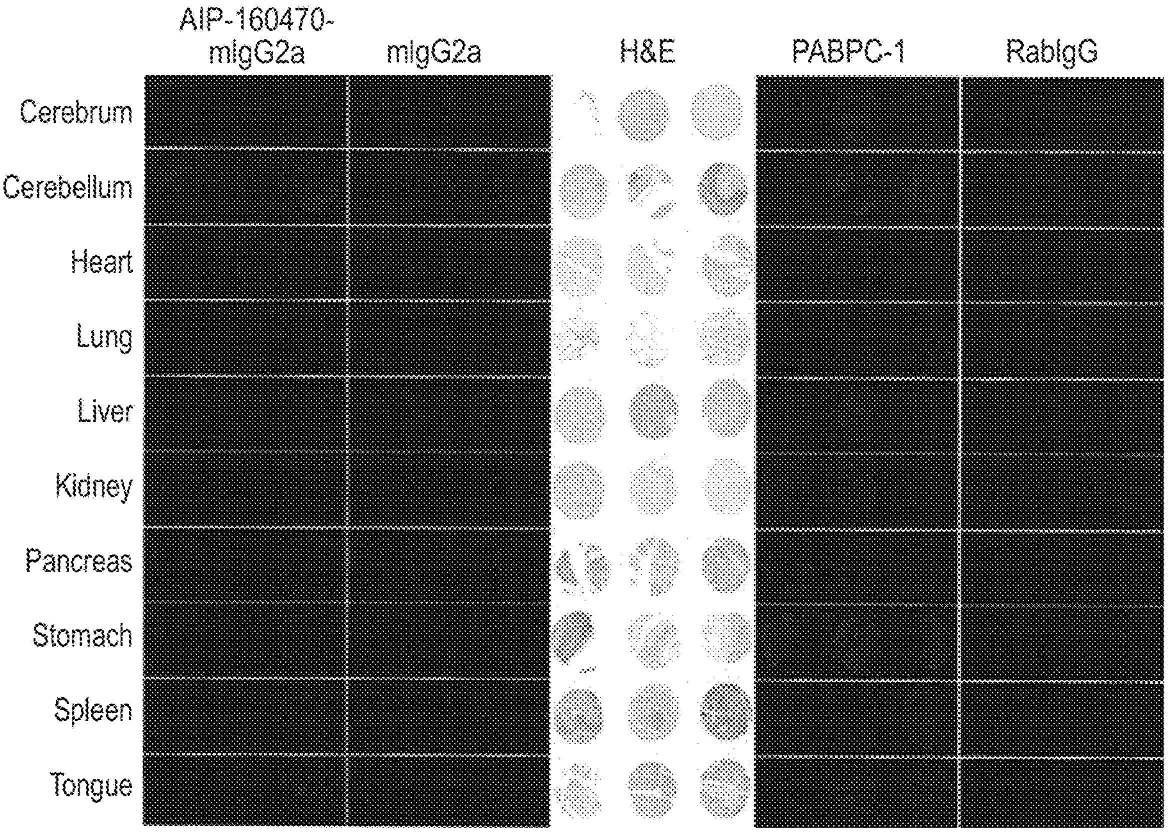

AIP-160470-mIgG2a immunoreactivity was observed on normal tissues of the 90 cores. Only the stomach and cerebellum displayed a diffuse non-definitive signal over isotype control, each in one of three cores with signs of autolysis. A faint heterogeneous signal was detected in serous acinar glandular epithelium in tongue (head and neck salivary gland), which are secretory in nature, increasing the likelihood of non-specific binding. In contrast to AIP-160470-mIgG2a, the commercial polyclonal antibody raised against PABPC-1 showed immunoreactivity to both tumor tissues and normal tissues (FIGS. 54A and 54B). In a separate analysis, tumor-selective binding was also observed by IHC assessment of colorectal cancer and normal human liver, kidney, stomach, heart, pancreas, and lung tissues.

The potential species cross-reactivity of ATRC-101 was assessed in normal cynomolgus monkey and mouse tissues in a non-GLP study. The concentration of ATRC-101 antibody used for this assessment was shown to preferentially and distinguishably label viable malignant cells within the positive control mouse EMT6 tumor and not label the adjacent skin or stroma. In fresh frozen normal cynomolgus monkey tissues representing 15 organ types, no definitive staining over isotype control was detected under these conditions. In fresh frozen normal mouse tissues representing 30 distinct organ types, most showed no definitive reactivity. Faint to minimal staining was observed in mouse oral cavity, stomach, small intestine, and spleen.

No binding of chimeric parental antibody AIP-192482-mIgG2a and chimeric antibody AIP-160470-mIgG2a to normal human PBMC preparations was observed by flow cytometry at concentrations at which binding to ex vivo EMT6-BALB/c syngeneic tumor cells was observed.

Example 12. ATRC-101 and ATRC-101 Variant Binding Affinity and In Vitro Activity As explained above, the in vitro activity of ATRC-101 was assessed in the Target and Effector Dual Engagement Assay. This assay uses engineered Jurkat cells carrying a luciferase reporter and ex vivo EMT6 tumor cells (from frozen stock) to detect dual Fv and Fc engagement. The FcγRIIa-H reporter gene is activated in the presence of EMT6 ex vivo cells and ATRC-101 protein, and results in the expression of luciferase. The activity of the reporter gene is determined by the Bio-Glo™ Luciferase Assay System.

In this assay, ATRC-101 induced luciferase expression with a half-maximal effective concentration ($EC_{50}$) of 67.8±37 nM. When the assay was performed using cultured EMT6 cells, which do not express detectable levels of ATRC-101 target, no luciferase signal was detected. Similarly, an aglycosylated Fc-variant of ATRC-101, which harbors an N297A mutation and therefore lacks Fc-effector function, did not induce luciferase signal in this assay. These data indicate that both target binding to the Fv region and FcγR2a engagement by the Fc region are required for activity of ATRC-101 in the Target and Effector Dual Engagement Assay.

The in vitro potency in the Target and Effector Dual Engagement Assay was greatest for ATRC-101 (AIP-160470-hIgG1), followed by the sequence-optimization variant AIP-133645-hIgG1, and then the parental antibody AIP-192482-hIgG1. Similarly, in vivo potency in the EMT6-BALB/c syngeneic mouse tumor model was greatest for the chimeric variant of ATRC-101 (AIP-160470-mIgG2a), followed by the chimeric variant AIP-133645-mIgG2a, with the chimeric variant of the parental antibody AIP-192482-mIgG2a showing the lowest anti-tumor effect.

In vitro ADCC and CDC assays were performed to assess whether ADCC or CDC contribute to the mechanism of action of ATRC-101. The ADCC assay used a CD16-transfected NK92 cell line as effector cells and, as target cells, either tumor-derived ex vivo EMT6 cells, which express the target, or cultured EMT6 cells, which do not express target. The chimeric antibody AIP-160470-mIgG2a did not demonstrate cell killing activity of mouse ex vivo EMT6, ex vivo Renca, or ex vivo LLC1 cells in this assay, while a positive control antibody AIP-171125-mIgG2a demonstrated killing of various target cells.

Similarly, AIP-192482-mIgG2a did not show CDC activity in the CDC assay using rabbit sera as a source of complement and tumor-derived ex vivo EMT6 cells as target cells. These data indicate that ATRC-101 does not appear to act through either ADCC or CDC mechanisms.

Assessment of Cytokine Release Induced by ATRC-101 in Human Peripheral Blood Mononuclear Cell and Whole Blood In Vitro Assays Systemic activation of immune cells by monoclonal antibodies can lead to cytokine release syndrome. It has been shown that an in vitro cytokine release assay (CRA), using immobilized antibody and human PBMCs, is predictive of cytokine release syndrome in patients. The ability of ATRC-101 to induce cytokine release in vitro was assessed using human PBMC and whole blood versions of a CRA at Charles River Laboratories (Portishead, UK).

In the PBMC version of the CRA, the ability of ATRC-101 to induce cytokine release was assessed on PBMCs obtained from multiple healthy human donors. This assay format uses test and control articles immobilized at 1 μg/well and is considered capable of predicting cytokine storm responses similar to those observed during the phase I clinical trial of the therapeutic monoclonal antibody TGN1412. Anti-CD28 clone 28.1 (Ancell Corp., Bayport, Minn., USA) and muromonab anti-CD3 (Orthoclone OKT3) were used as positive controls in the PBMC CRA. A human IgG1 (hIgG1) isotype antibody (targeting (3-galactosidase), formulation buffer, and Dulbecco's phosphate-buffered saline (DPBS) were included as negative controls.

In the whole blood version of the CRA, the ability of ATRC-101 to cause cytokine release was assessed on whole blood from multiple healthy, human donors. This assay format uses test articles in solution at a concentration of 1.1 nM. Anti-CD28 and alemtuzumab (anti-CD52) were used as positive controls and hIgG1 isotype antibody, formulation buffer, and DPBS were included as negative controls in this assay format.

In both the PBMC and whole blood versions of the CRA, the cytokine release observed with ATRC-101 was comparable to the cytokine release observed with the hIgG1 isotype control. Cytokine release related to ATRC-101 was generally significantly lower than that observed in response to stimulation with the relevant positive control antibodies. Based on these data, ATRC-101 poses a low risk of triggering cytokine release in humans.

Example 13. In Vivo Pharmacology

ATRC-101 was shown to bind to in vitro reconstituted complexes containing in vitro transcribed RNA and (i) recombinant human/non-human primate PABPC-1 or (ii) recombinant mouse PABPC-1 with comparable affinity and to bind to tumor cores from both human and mouse. Therefore, the in vivo pharmacological evaluation of ATRC-101 in syngeneic mouse models was carried out using the clinical candidate ATRC-101 as well as sequence variants of ATRC-101 expressed with human or mouse Fc regions. Mouse chimeric variants are expected to have higher anti-tumor efficacy in syngeneic mouse models than hIgG1, since hIgG1 has a reduced affinity for mouse Fc gamma receptors.

Preclinical Efficacy and Safety Assessments of MFC-042 and ATRC-101 in Syngeneic EMT6 Breast Cancer Model (Studies ATRC-101.PD.18.01 and ATRC-101.PD.18.02)

The objective of this study was to evaluate the preclinical efficacy and safety endpoints of MFC-042 (harboring an identical human Fv region of ATRC-101 but expressed with a mouse IgG2a Fc region; also referred to as AIP-160470-mIgG2a) and ATRC-101 administered to naïve and EMT6 syngeneic breast cancer tumor-bearing female BALB/c mice. This study was composed of two parts that were conducted concurrently: assessment of MFC-042 (Part A; ATRC-101.PD.18.01) and ATRC-101 (Part B; ATRC-101.PD.18.02).

In Part A of the study, seven groups of female BALB/c mice (15 animals/group) with established subcutaneous EMT6 tumors (group mean tumor volumes (MTV)=112 to 113 $mm^3$) were dosed via intraperitoneal (IP) injection with 0 (vehicle), 0.1 mg/kg, 0.3 mg/kg, 1 mg/kg, 3 mg/kg, 10 mg/kg, or 30 mg/kg MFC-042 on Days 1, 4, 8, 11, and 15. Two groups of non-tumor bearing (naïve) mice (15 animals/group) were treated with vehicle or 30 mg/kg MFC-042 at the same dose regimen. Animals were euthanized for necropsy examinations on Day 16.

In Part B of the study, four groups of female BALB/c mice (15 animals/group) with established subcutaneous EMT6 tumors (group MTV=108 $mm^3$) were dosed via IP injection with 0 mg/kg (vehicle), 3 mg/kg, 10 mg/kg, or 30 mg/kg ATRC-101 on Days 1, 4, 8, 11, and 15. Two groups of naïve mice (15 animals/group) were treated with vehicle or 30 mg/kg ATRC-101 at the same dose regimen. Animals were euthanized for necropsy examinations on Day 16.

The following parameters and end points were evaluated in this study: mortality/moribundity, clinical signs, body weights, overall efficacy assessment, clinical pathology parameters (hematology and clinical chemistry), serum cytokine evaluation, serum test article concentrations, gross necropsy findings, organ weights, and microscopic examinations (9 organs and plus tumor tissue in tumor-bearing animals). Overall efficacy was determined based on tumor growth inhibition (TGI), defined as the percent difference between MTVs of treated and control groups, and was assessed on Day 15 (Part A) or Day 14 (Part B).

Repeat-dose IP administration of MFC-042 and ATRC-101 to naïve and EMT6 breast cancer tumor-bearing female BALB/c mice was well tolerated at dose levels up to 30 mg/kg.

Figure 55A:
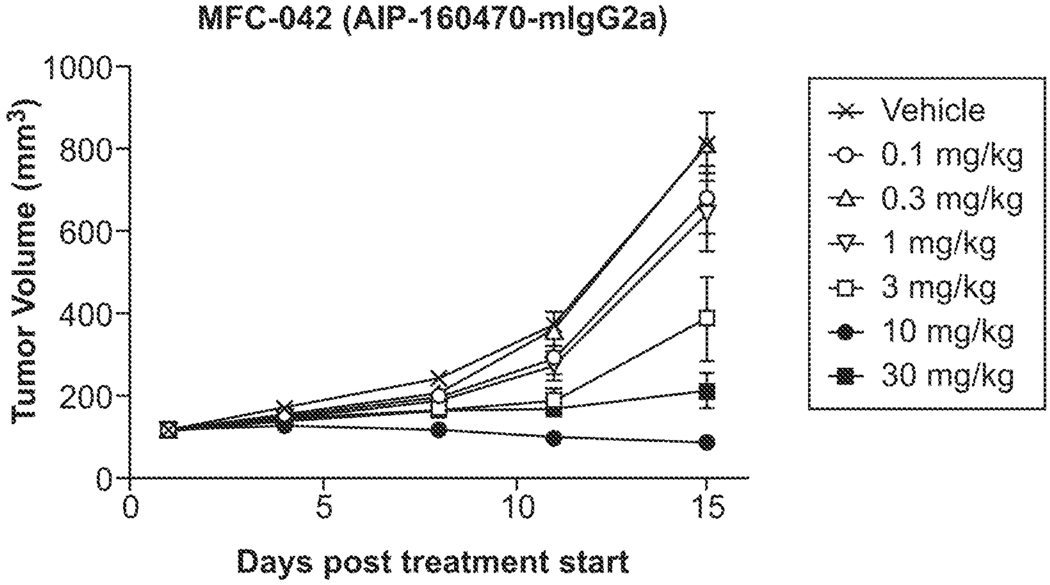

In Part A (FIG. 55A), the MTV of Group 1 (vehicle control) had reached 787 $mm^3$ on Day 15, with individual tumor volumes ranging from 288 to 1352 $mm^3$. By comparison, MFC-042 treatment groups at lower doses (Groups 2 through 4) did not differ statistically from the vehicle control group or each other ($p>0.05$ using the Mann-Whitney U test), with MTVs of 719, 847, and 726 $mm^3$, equivalent to 9, -8, and 8% TGI for treatment groups that received 0.1, 0.3 and 1 mg/kg MFC-042, respectively. Higher doses of MFC-042 (3, 10, and 30 mg/kg) reduced MTVs to 221 (72% TGI), 92 (88% TGI) and 196 $mm^3$ (75% TGI), respectively, and differed significantly from Group 1 ($p<0.01$ for 3 mg/kg and $p<0.001$ for 10 and 30 mg/kg). Notably, all three high doses achieved TGIs that were well above the 60% threshold considered by the contract research organization to indicate potential therapeutic activity. Minimal anti-tumor activity was observed at 3 mg/kg with serum concentrations ranging from 16.6 to 20.3 μg/mL. Maximal anti-tumor activity was noted at 10 mg/kg with measured serum concentrations ranging from 21.9 to 87.5 μg/mL at 6 hours post-dose on Day 1. Microscopically, tumors in mice treated with ≥3 mg/kg of MFC-042 had smaller areas of necrosis, occasionally lacked a central area of necrosis and were often accompanied by mixed cell inflammation (≥10 mg/kg). Tumor emboli were not observed in the lung of mice administered MFC-042 at ≥10 mg/kg.

Figure 55B:
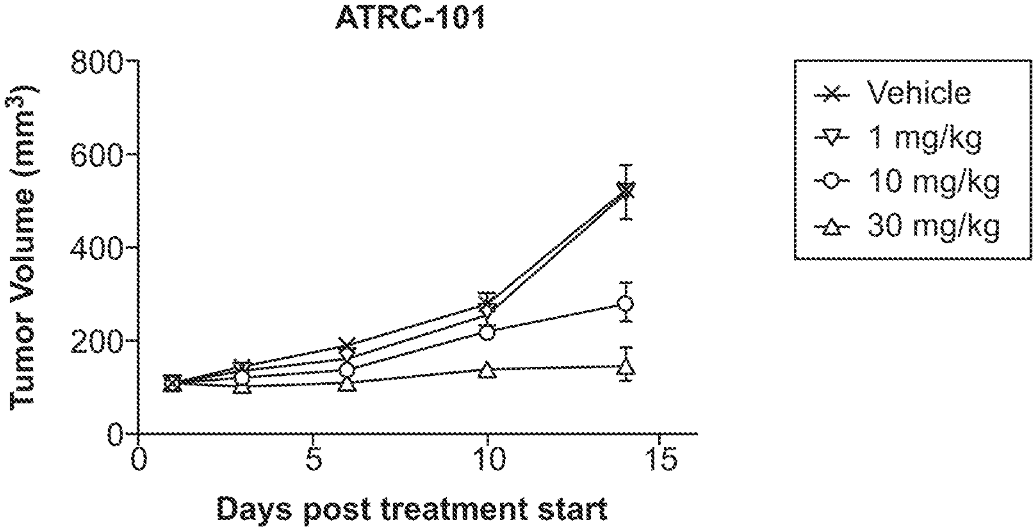

In Part B (FIG. 55B), the MTV of Group 1 (vehicle control) had reached 486 $mm^3$ on Day 14, with individual tumor volumes ranging from 221 to 936 $mm^3$. By comparison, treatment with 1 mg/kg ATRC-101 (Group 2) did not differ statistically from the vehicle control (p>0.05) with a MTV of 550 $mm^3$, equivalent to −13% TGI. In contrast, higher doses of ATRC-101 (10 and 30 mg/kg) reduced MTVs to 256 $mm^3$ (47% TGI) and 75 $mm^3$ (85% TGI), respectively, and differed significantly from Group 1 (p<0.01 for 10 mg/kg and p<0.001 for 30 mg/kg). Notably, 30 mg/kg ATRC-101, where the highest measured serum concentration was 295 μg/mL, exceeded the 60% TGI threshold to indicate potential therapeutic activity. The lower potency of ATRC-101 compared to MFC-042 is expected given that ATRC-101 is a fully human antibody with a reduced affinity for mouse Fc gamma receptors. Microscopically, tumors in mice treated with 30 mg/kg of ATRC-101 had smaller areas of necrosis, occasionally lacked a central area of necrosis and had a lower mitotic rate. In addition, tumor emboli were not observed in the lung of mice treated with ATRC-101.

In summary, administration of MFC-042 (3 mg/kg, 10 mg/kg, and 30 mg/kg) or ATRC-101 (10 mg/kg and 30 mg/kg) significantly inhibited the growth of syngeneic EMT6 mammary carcinoma tumors in female BALB/c mice. All treatments were well-tolerated.

Efficacy of ATRC-101 Variants in the Syngeneic Mouse Tumor Models

The anti-tumor efficacy of chimeric ATRC-101 variants was assessed in EMT6, CT26, and E0711 syngeneic tumor models, chosen based on their demonstrated responsiveness to checkpoint inhibitor therapy. These studies were performed using mouse chimeric variants, harboring a human Fv region expressed with a mouse Fc region to enable optimal interactions with mouse Fc gamma receptors in vivo.

Efficacy of ATRC-101 Variants Alone or in Combination with PD-1 Blockade in the Syngeneic Mouse Tumor Model Four studies were performed to assess the anti-tumor efficacy of mIgG2a chimeric variants of ATRC-101 in the EMT6 syngeneic mouse breast cancer model. In all three studies, BALB/c mice were inoculated subcutaneously with $1\times10^6$ EMT6 mouse mammary carcinoma cells on Day 0 and test article administration was initiated when tumors were established. Statistical comparisons between tumor volumes from different treatment groups were conducted by Wilcoxon rank-sum test of the NAAC and the normalized growth rate metric (NGRM) parameters developed at Atreca, Inc.

In one study (Study EFF-010), the EMT6-BALB/c syngeneic mouse tumor model was used to evaluate the impact of Fc-effector function on anti-tumor efficacy following AIP-192482 isotype variant administration. The parental antibody AIP-192482 was expressed as an Fc-effector competent mIgG2a (AIP-192482-mIgG2a), an Fc-effector mutant non N-glycosylated mIgG2a (AIP-192482-mIgG2a-N297A), or mouse immunoglobulin G, subclass 1 (mIgG1; AIP-192482-mIgG1) or mouse immunoglobulin G, subclass 3 (mIgG3; AIP-192482-mIgG3) with weak Fc-effector function compared to mIgG2a.

Figure 56:
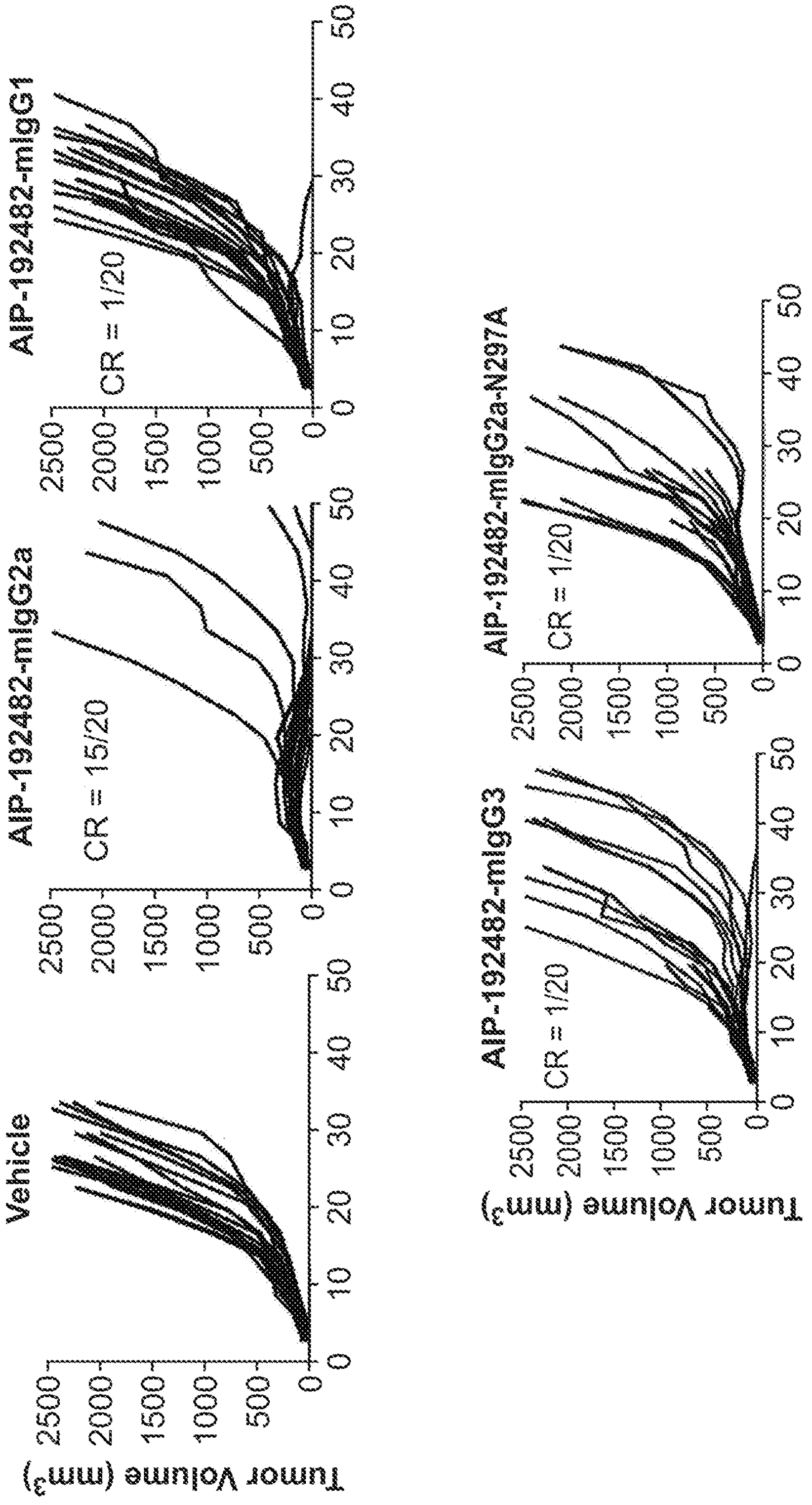
FIG. 56 shows impact of Fc-effector function on anti-tumor efficacy of chimeric variants of parental antibody AIP-192482 in the EMT6-BALB/c syngeneic mouse tumor model. BALB/c mice were inoculated with $1\times10^6$EMT6 tumor cells and randomized to treatment groups 6 days later. Starting 7 days post EMT6 inoculation, with a group average mean tumor volume of 94.5 $mm^3$, mice were dosed IP twice weekly with 10 mg/kg of AIP-192482-mIgG2a, AIP-192482-mIgG1, AIP-192482-mIgG3, or AIP-192482-mIgG2a-N297A chimeric variants of the parental antibody AIP-192482 or vehicle (phosphate-buffered saline). The tumor volumes of individual animals from each treatment group are shown (20 animals per group). For treatment groups with CR, the ratio of mice with CR to total animals per group is shown. CR=complete tumor regression; IP=intraperitoneal(ly); kg=kilogram; mg=milligram; mIgG1=mouse immunoglobulin G, subclass 1; mIgG2a=mouse immunoglobulin G, subclass 2a; mIgG3=mouse immunoglobulin G, subclass 3; N297A=asparagine to alanine modification at position 297; mm=millimeter.

In this study, administration of 10 mg/kg AIP-192482-mIgG2a led to significant anti-tumor efficacy compared to the vehicle control (p<0.0001 based on one-sided Wilcoxon rank-sum test of NAAC or NGRM) with complete tumor regression (CR) observed in 15 of 20 mice (FIG. 56). No significant anti-tumor efficacy was observed following administration of the AIP-192482-mIgG2a-N297A variant, while AIP-192482-mIgG1 and AIP-192482-mIgG3 displayed some anti-tumor activities (p<0.001 and p=0.01, respectively, based on Wilcoxon rank-sum test of NAAC). These results indicate that Fc-effector function is linked to and required for the anti-tumor activity of chimeric, parental AIP-192482 in the EMT6-BALB/c syngeneic mouse tumor model.

In another study (Study EFF-016), seven groups of mice with established subcutaneous EMT6 tumors (group mean tumor volume of 156 $mm^3$) were randomized to treatment groups of 20 mice per group on Study Day 6. Mice were dosed IP with (i) 10 mg/kg of AIP-192482-mIgG2a, (ii) 5 mg/kg of AIP-192482-mIgG2a, (iii) 5 mg/kg of AIP-133645-mIgG2a, (iv) 2.5 mg/kg of AIP-133645-mIgG2a, (v) 5 mg/kg of AIP-160470 mIgG2a, or (vi) 2.5 mg/kg of AIP-160470-mIgG2a on Days 7, 10, 14, 17, 21, 24, and 27. Vehicle control animals were dosed with Dulbecco's PBS (DPBS).

Figure 57:
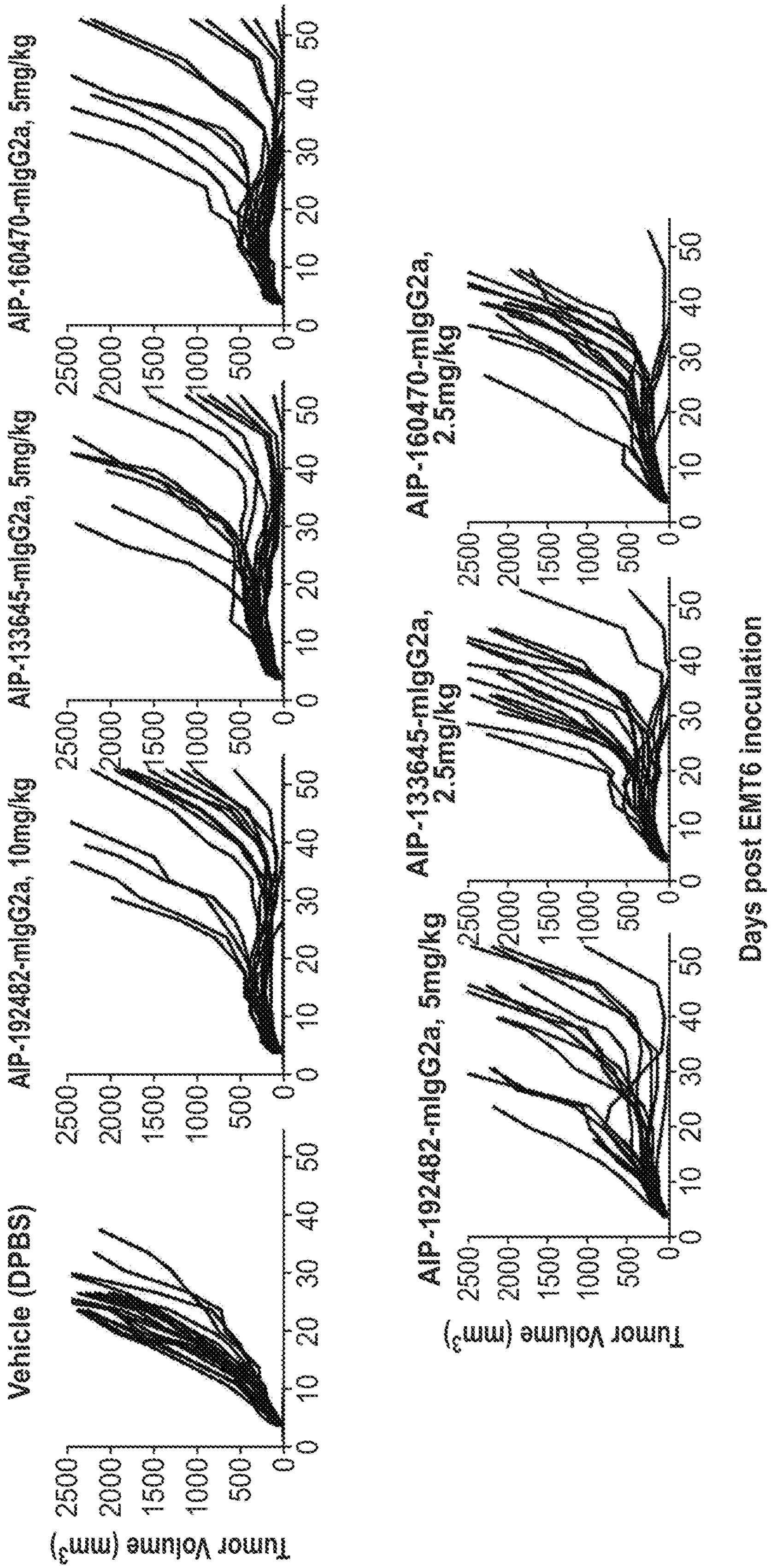
FIG. 57 shows anti-tumor efficacy of chimeric parental antibody AIP-192482 and Sequence-optimized variants in the EMT6-BALBc syngeneic mouse tumor model, study EFF-016. In study EFF-016, BALB/c mice were inoculated with $1\times10^6$ EMT6 tumor cells and randomized to treatment groups (20 animals per group) 6 days later. Starting 7 days post EMT6 inoculation (group average tumor volume of 156 $mm^3$), mice were dosed IP twice weekly with indicated doses of chimeric parental antibody AIP-192482-mIgG2a, chimeric sequence-optimized variant AIP-133645-mIgG2a, chimeric antibody AIP-160470-mIgG2a, or vehicle (DPBS). Shown are the tumor volumes of individual mice in each treatment group through Day 53. DPBS=Dulbecco's phosphate-buffered saline; IP=intraperitoneally; mIgG2a=mouse immunoglobulin G, subclass 2a; mm=millimeter.

Administration of AIP-192482-mIgG2a, AIP-133645-mIgG2a, or AIP-160470-mIgG2a led to a significant reduction in tumor volume at each tested dose level compared to the vehicle control group by metric NAAC and NGRM analyses (FIG. 57). At the dose of 5 mg/kg, both AIP-133645-mIgG2a and AIP-160470-mIgG2a had significantly greater anti-tumor efficacy than AIP-192482-mIgG2a (p<0.05 by NAAC and NGRM analysis for both comparisons. At 5 mg/kg, the largest effect size compared to vehicle control administration (indicative of anti-tumor effect) was observed for AIP-160470-mIgG2a. [

Administration of AIP-192482 mIgG2a, AIP-133645-mIgG2a, or AIP-160470-mIgG2a at each dose level led to a significant survival benefit compared to vehicle administration (p<0.001 for all test articles and dose levels), with the median survival was delayed relative to the vehicle control group.

All mIgG2a chimeric ATRC-101 variants showed anti-tumor efficacy in this study, with the greatest effect size observed for AIP-160470-mIgG2a, the chimeric version of ATRC-101.

In Study EFF-004, the EMT6-BALB/c syngeneic mouse tumor model was used to evaluate the impact of 20 mg/kg AIP-192482-mIgG2a on tumor volume and survival when administered alone or in combination with 10 mg/kg anti-mouse PD-1 monoclonal antibody (clone RMP1-14, BioXCell). In this study, 20 mg/kg AIP-192482-mIgG2a showed significant anti-tumor activity when administered alone or in combination with anti-mouse PD-1 monoclonal antibody, while anti-mouse PD-1 monoclonal antibody did not show anti-tumor efficacy when administered as a monotherapy.

In this study, administration of AIP-192482-mIgG2a alone and AIP-192482-mIgG2a in combination with anti-mouse PD-1 monoclonal antibody lead to CR in 11 of 16 and 13 of 15 mice, respectively. Animals with CR were re-challenged on Day 51, 24 days after the last treatment. Of the 24 mice that had CR following administration of AIP-192482-mIgG2a alone or in combination with anti-mouse PD-1 monoclonal antibody, 20 remained tumor free post re-challenge, indicating that AIP-192482-mIgG2a can induce immunologic memory.

The impact of co-administration with anti-mouse PD-1 monoclonal antibody was further explored in study EFF-020. Female BALB/c mice with established subcutaneous EMT6 tumors were randomized to treatment groups of 20 mice per group on study Day 7, with a group mean tumor volume of approximately 104 $mm^3$. Mice were dosed IP with vehicle (DPBS) or 2 dose levels each of AIP-192482-mIgG2a or AIP-160470-mIgG2a on Days 7, 11, 14, 18, 21, 25, 28. Mice were also dosed IP with 10 mg/kg anti-mouse PD-1 monoclonal antibody (clone RMP1-14, BioXCell) or vehicle (DPBS) on Days 7, 11, 14, 18.

Figure 58A:
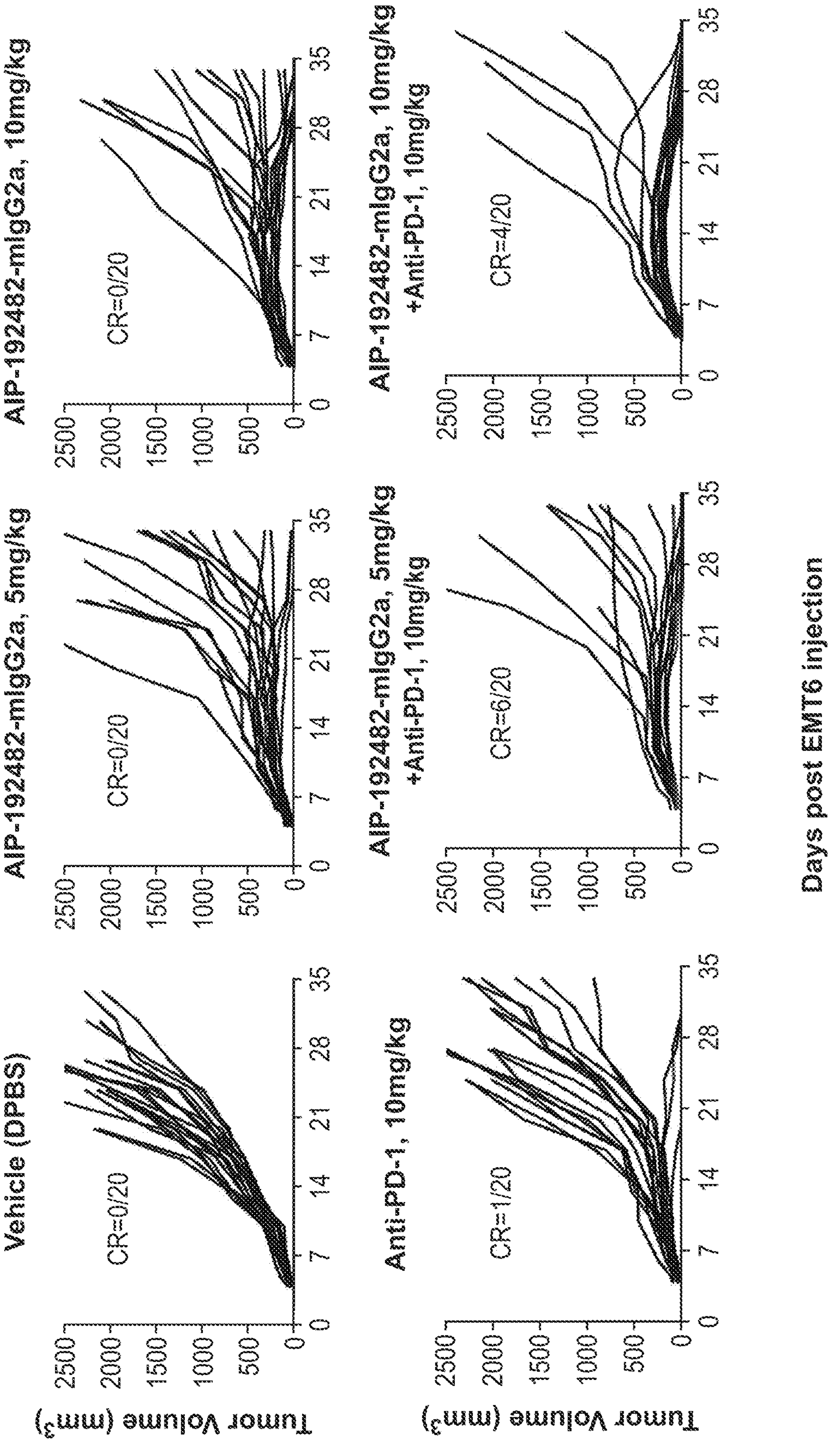
FIGS. 58A and 58B show the anti-tumor efficacy of chimeric parental antibody AIP-192482-mIgG2a and Sequence-optimized variants in the EMT6-BALBc syngeneic mouse tumor model, study EFF-020. In study EFF-020, BALB/c mice were inoculated with $1\times10^6$ EMT6 tumor cells and randomized to treatment groups (20 animals per group) 6 days later, when the group average tumor volume was approximately $10^4$ $mm^3$. Mice were dosed IP twice weekly with 5 mg/kg or 10 mg/kg of chimeric parental antibody AIP-192482-mIgG2a, 2.5 mg/kg or 5 mg/kg of chimeric antibody AIP-160470-mIgG2a, or vehicle (DPBS) starting on Day 7 for a total of 7 doses. Mice were also dosed IP with 10 mg/kg anti-mouse PD-1 monoclonal antibody or vehicle (DPBS) twice weekly starting on Day 7 for a total of 4 doses. In the monotherapy groups, vehicle was administered according to the dosing schedule of the absent test article.

In this study, monotherapy treatment groups showed a significant reduction in tumor growth compared to vehicle control group ($p<0.01$ for both NAAC and NGRM metric analyses for each comparison. Administration of 5 mg/kg or 10 mg/kg AIP-192482 mIgG2a in combination with anti-mouse PD-1 monoclonal antibody led to a significant reduction in tumor volumes compared to the vehicle control group, the anti-mouse PD-1 monotherapy group, and the respective AIP-192482-mIgG2a monotherapy group ($p<0.05$ by both NAAC and NGRM metric analysis for each comparison; (FIG. 58A). The number of CRs increased from 0 in the AIP-192482-mIgG2a monotherapy groups to 6 CRs and 4 CRs, respectively, at 5 mg/kg or 10 mg/kg AIP-192482-mIgG2a in combination with anti-mouse PD-1 monoclonal antibody.

Figure 58B:
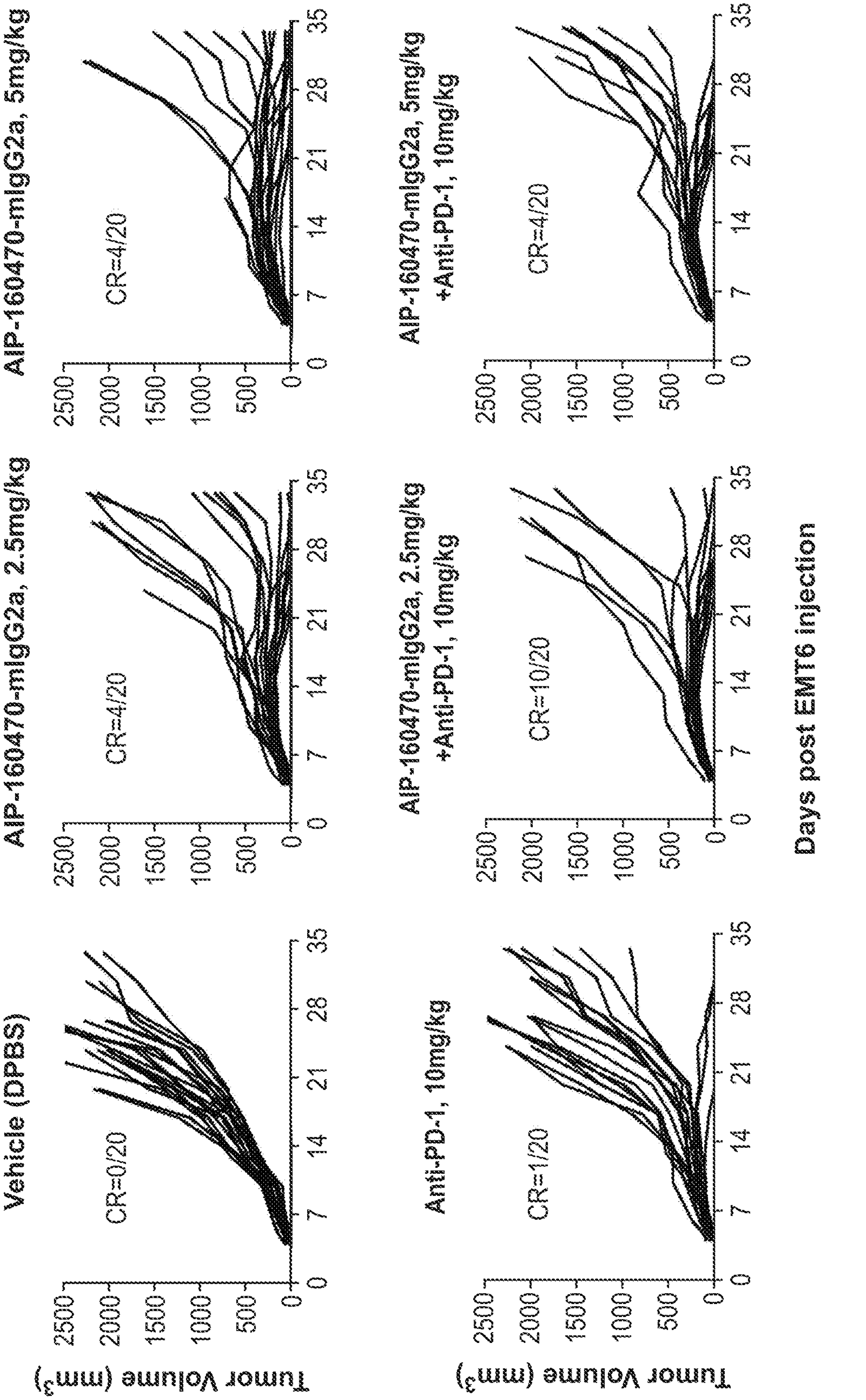

In this study, administration of 2.5 mg/kg or 5 mg/kg AIP-160470-mIgG2a in combination with anti-mouse PD-1 monoclonal antibody led to a significant reduction in tumor volumes compared to the vehicle control group and the anti-mouse PD-1 monotherapy group ($p<0.001$ by both NAAC and NGRM metric analysis for each comparison; FIG. 58B). Tumor volumes were not significantly different between AIP-160470-mIgG2a administration in combination with anti-mouse PD-1 monoclonal antibody and AIP-160470-mIgG2a administration as a monotherapy at either dose level. However, the effect size and number of CR increased Efficacy of ATRC-101 Variants in the CT26-BALB/c Syngeneic Mouse Tumor Model Two studies were performed, EFF-031 and EFF-039, to assess the anti-tumor efficacy of mIgG2a chimeric variants of ATRC-101 in the CT26-BALB/c syngeneic mouse tumor model. In both studies, BALB/c mice were inoculated subcutaneously with $1\times10^6$ CT26 mouse colon carcinoma cell line and test article administration was initiated when tumors were established. Statistical comparisons between tumor volumes from different treatment groups were conducted by Wilcoxon rank-sum test of the NAAC and the NGRM parameters developed at Atreca, Inc.

In Study EFF-031, the CT26-BALB/c syngeneic mouse tumor model was used to evaluate the impact of (i) AIP-192482-mIgG2a, (ii) AIP-133645-mIg2a, or (iii) AIP-160470-mIgG2a, dosed IP at 20 mg/kg three times per week for 3 weeks, on tumor volume and survival. In this study, all three test articles showed significant anti-tumor efficacy and survival benefit compared to a vehicle control group dosed with DPBS.

In Study EFF-039, mice with established subcutaneous CT26 tumors (group mean tumor volume of approximately 145 $mm^3$) were randomized to treatment groups on Study Day 9. Mice were dosed IP with 20 mg/kg AIP-192482-mIgG2a (40 mice) or vehicle (DPBS; 20 mice) on Days 9, 11, 13, 15, 18, 20, 22, 25, 27, and 29. Tumors in the vehicle control group showed rapid growth of tumor volumes FIG. 59A). Anti-tumor activity of AIP-192482-mIgG2a was significantly greater than in the vehicle control group ($p=1.21\times10^{-10}$ for NAAC and $p=1.63\times10^{-11}$ for NGRM). Significant survival benefit was observed in the AIP-192482-mIgG2a treatment group compared to the vehicle control.

Figure 59A:
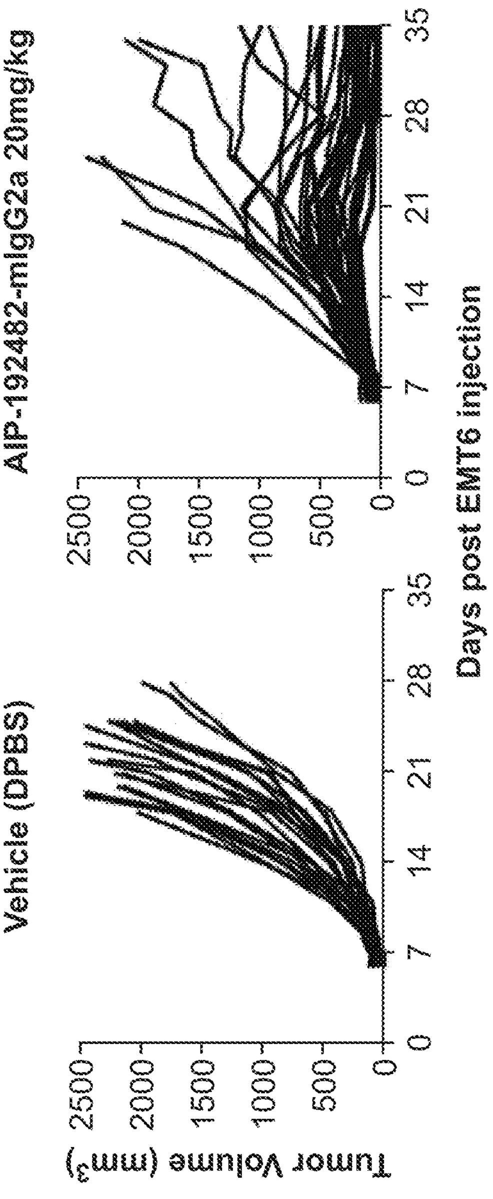
FIGS. 59A and 59B show the anti-tumor efficacy of chimeric parental antibody AIP-192482-mIgG2a in the CT26-BALBc syngeneic mouse tumor model, Study EFF-039. In study EFF-039, BALB/c mice were inoculated with $1\times10^6$ CT26 tumor cells and randomized to treatment groups 6 days later. Starting 7 days post CT26 inoculation (group average tumor volume of approximately 145 $mm^3$), mice were dosed IP three times per week with 20 mg/kg of chimeric parental antibody AIP-192482-mIgG2a (40 animals) or vehicle (DPBS; 20 animals).
Figure 59B:
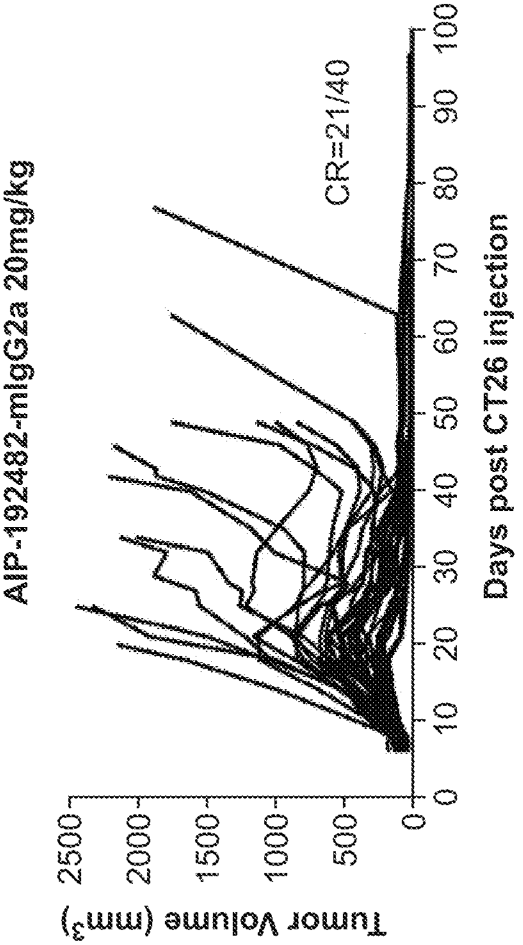

Animal dosed with AIP-192482-mIgG2a were observed through Day 97 to assess the durability of response. By Day 97, the group that had been administered AIP-192482-mIgG2a showed CR in 21 of 40 mice (FIG. 59B).

Animals with CR were inoculated with $1\times10^6$ CT26 cells in the contralateral flank on Study Day 99, 70 days after the last AIP-192482-mIgG2a dose was administered. In parallel, 20 antibody-naïve, age-matched BALB/c mice were inoculated with $1\times10^6$ CT26 cells on Study Day 99 as a control. No test article doses were administered in the re-challenge. Naïve BALB/c control mice inoculated with CT26 cells showed rapid tumor growth. In contrast, all 21 mice that had responded with a CR to the previous administration of AIP-192482-mIgG2a remained tumor free following re-challenge, indicating that AIP-192482-mIgG2a administration can produce a durable anti-tumor response and immunological memory in the CT26 syngeneic mouse tumor model following administration at either dose level of AIP-160470-mIgG2a in combination with anti-mouse PD-1 monoclonal antibody compared to the respective AIP-160470-mIgG2a monotherapy, from 4 CRs to 10 CRs at 2.5 mg/kg and from 4 CRs to 8 CRs at 5 mg/kg AIP-160470-mIgG2a.

Together, the data from these indicate that administration of ATRC-101 variants have anti-tumor activity in the CT26-BALB/c syngeneic mouse tumor model and that the activity is enhanced in combination with PD-1 blockade.

Efficacy of ATRC-101 Variants in the CT26-BALBc Syngeneic Mouse Tumor Model

Two studies were performed, EFF-031 and EFF-039, to assess the anti-tumor efficacy of mIgG2a chimeric variants of ATRC-101 in the CT26-BALB/c syngeneic mouse tumor model. In both studies, BALB/c mice were inoculated subcutaneously with $1\times10^6$ CT26 mouse colon carcinoma cell line and test article administration was initiated when tumors were established. Statistical comparisons between tumor volumes from different treatment groups were conducted by Wilcoxon rank-sum test of the NAAC and the NGRM parameters developed at Atreca, Inc.

In Study EFF-031, the CT26-BALB/c syngeneic mouse tumor model was used to evaluate the impact of (i) AIP-192482-mIgG2a, (ii) AIP-133645-mIg2a, or (iii) AIP-160470-mIgG2a, dosed IP at 20 mg/kg three times per week for 3 weeks, on tumor volume and survival. In this study, all three test articles showed significant anti-tumor efficacy and survival benefit compared to a vehicle control group dosed with DPBS.

In Study EFF-039, BALB/c mice with established subcutaneous CT26 tumors (group mean tumor volume of approximately 145 $mm^3$) were randomized to treatment groups on Study Day 9. Mice were dosed IP with 20 mg/kg AIP-192482-mIgG2a (40 mice) or vehicle (DPBS; 20 mice) on Days 9, 11, 13, 15, 18, 20, 22, 25, 27, and 29. Tumors in the vehicle control group showed rapid growth of tumor volumes (FIG. 59A). Anti-tumor activity of AIP-192482-mIgG2a was significantly greater than in the vehicle control group ($p=1.21\times10^{-10}$ for NAAC and $p=1.63\times10^{-11}$ for NGRM). Significant survival benefit was observed in the AIP-192482-mIgG2a treatment group compared to the vehicle control.

Animal dosed with AIP-192482-mIgG2a were observed through Day 97 to assess the durability of response. By Day 97, the group that had been administered AIP-192482-mIgG2a showed CR in 21 of 40 mice (FIG. 59B).

Animals with CR were inoculated with $1\times10^6$ CT26 cells in the contralateral flank on Study Day 99, 70 days after the last AIP-192482-mIgG2a dose was administered. In parallel, 20 antibody-naïve, age-matched BALB/c mice were inoculated with $1\times10^6$ CT26 cells on Study Day 99 as a control. No test article doses were administered in the re-challenge. Naïve BALB/c control mice inoculated with CT26 cells showed rapid tumor growth. In contrast, all 21 mice that had responded with a CR to the previous administration of AIP-192482-mIgG2a remained tumor free following re-challenge, indicating that AIP-192482-mIgG2a administration can produce a durable anti-tumor response and immunological memory in the CT26-BALB/c syngeneic mouse tumor model.

Efficacy of ATRC-101 Variant AIP-192482-mIgG2a Alone and in Combination with PD-1 Blockade in E0771 Syngeneic Mouse Tumor Models The E0771-057BL/6 syngeneic mouse tumor model was used to evaluate the impact of administration of AIP-192482-mIgG2a, on tumor volumes when administered alone or in combination with an anti-mouse PD-1 monoclonal antibody (clone RMP1-14, BioXCell), in study EFF-006. C57BL/6 mice were inoculated subcutaneously with $1\times10^6$ cell of the E0771 mouse medullary breast adenocarcinoma cell line. Four groups of female mice with established subcutaneous E0771 tumors were randomized to treatment groups of 20 mice per group on study Day 8, with mean tumor volume of approximately 104 $mm^3$ in each group. Mice were dosed IP with 20 mg/kg AIP-192482-mIgG2a or vehicle (DPBS) on Days 9, 13, 16, 20, 23, 27, and 30. Mice were also dosed IP with 2.5 mg/kg anti-mouse PD-1 monoclonal antibody or vehicle (DPBS) on Days 9, 13, 16, and 20. Statistical comparisons between tumor volumes from different treatment groups were made by Wilcoxon rank-sum test of the NAAC and the NGRM parameters developed at Atreca, Inc.

Figure 60:
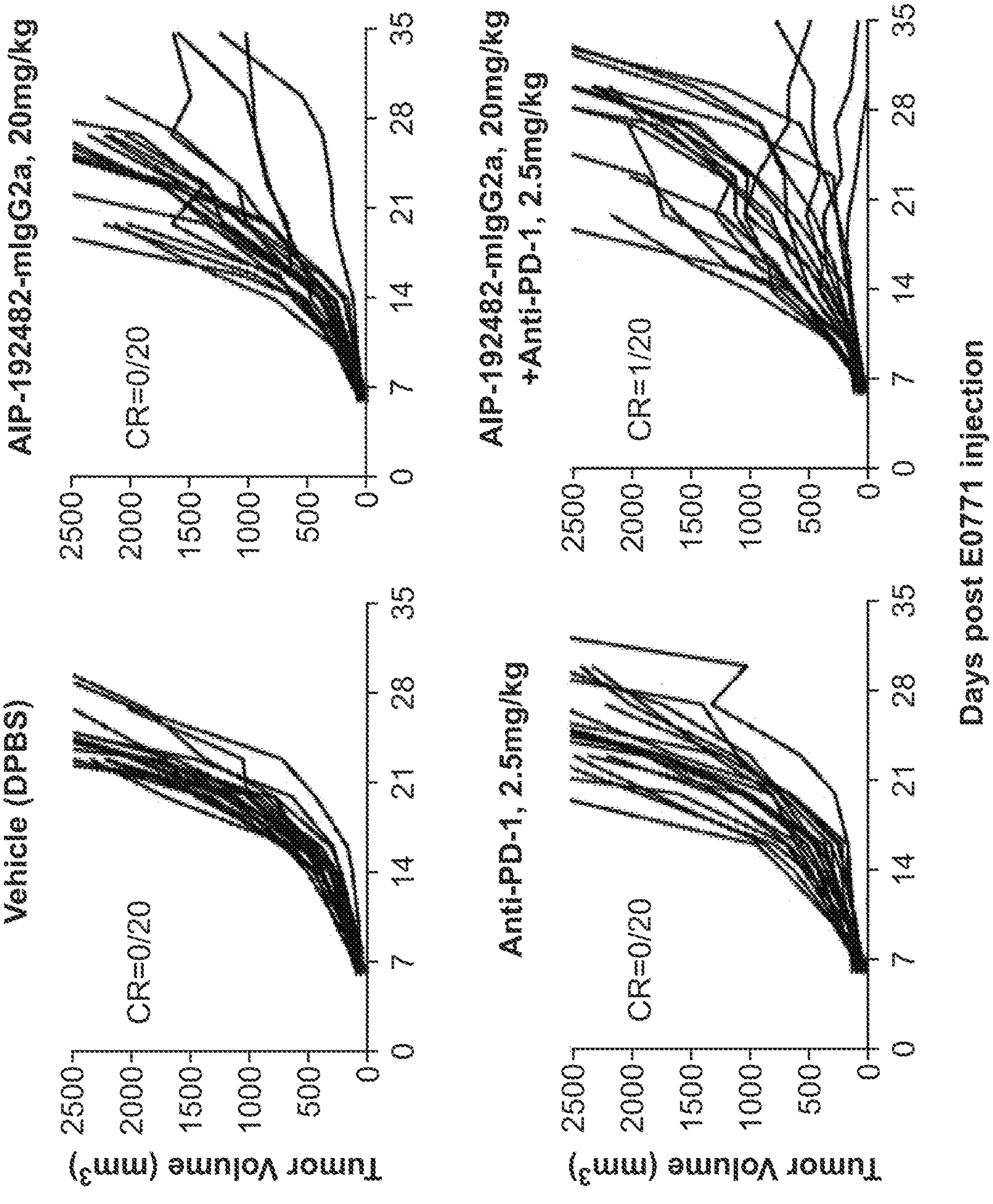
FIG. 60 shows the anti-Tumor Efficacy of Antibody AIP-192482-mIgG2a Alone or In Combination with PD-1 Blockade in the E0771-C57BL/6 syngeneic mouse tumor model, Study EFF-006. In study EFF-006, C57BL/6 mice were inoculated with $1\times10^6$E0771 tumor cells and randomized to treatment groups of 20 animals per group 8 days later, when the group average tumor volume was approximately 104 mm3. Starting 9 days post E0771 inoculation, mice were dosed IP twice weekly through Day 30 with 20 mg/kg of chimeric, parental antibody AIP-192482-mIgG2a or vehicle (DPBS). In addition, mice were dosed IP twice weekly with 2.5 mg/kg anti-mouse PD-1 monoclonal antibody or vehicle (DPBS) twice weekly starting on Day 9. In the monotherapy groups, vehicle was administered according to the dosing schedule of the absent test article. Shown are tumor volumes of individual mice in each treatment group through Day 35. The number of CRs in each treatment group are indicated.

In this study, administration of AIP-192482-mIgG2a or anti-mouse PD-1 monoclonal antibody alone led to delayed growth of tumor volumes in some animals but did not lead to a significant reduction in tumor volume compared to the vehicle control (FIG. 60). Administration of AIP-192482-mIgG2a in combination with anti-mouse PD-1 monoclonal antibody led to a significant reduction in tumor volumes compared to the vehicle administration ($p=0.0176$ for NAAC and $p=0.0007$ for NGRM), administration of anti-mouse PD-1 alone ($p=0.0455$ for NAAC and $p=0.00194$ for NGRM), and administration of AIP-192482-mIgG2a alone ($p=0.0262$ for NGRM).

These results indicate that administration of an ATRC-101 variant in combination with anti-mouse PD-1 monoclonal antibody increases anti-tumor efficacy compared to the respective monotherapies in the E0771-057BL/6 syngeneic mouse tumor model.

Impact of Host T Cells on Anti-Tumor Efficacy of AIP-192482-mIgG2a in the EMT6-BALB/c Syngeneic Mouse Tumor Model EMT6-BALB/c syngeneic mouse tumor models were used to assess the potential contribution of T cells to anti-tumor efficacy of the parental antibody AIP-192482-mIgG2a, which has anti-tumor activity in the EMT6-BALB/c mouse syngeneic tumor model.

In Study TMD04, anti-tumor efficacy of AIP-192482-mIgG2a was assessed in the presence or absence of an anti-mouse CD8a antibody, which depletes mouse CD8+ T cells. To assess anti-tumor efficacy, BALB/c mice were inoculated subcutaneously with EMT6 cells. Once tumors were established mice were dosed twice weekly with (i) the T cell-depleting anti-mouse CD8a antibody or vehicle (DPBS) and (ii) AIP-192482-mIgG2a or vehicle control (DPBS). In this study, administration of AIP-192482-mIgG2a led to a significant reduction in tumor growth in the absence of anti-mouse CD8a depleting antibody ($p<0.0001$ for comparison of both NAAC and NGRM; FIG. 61). When anti-mouse CD8a antibody was administered, anti-tumor efficacy of AIP-192482-mIgG2 was abrogated.

In Study EMT6-ATRC-e002, anti-tumor efficacy of AIP-192482-mIgG2a was assessed in EMT6 tumor-bearing BALB/c nude mice (BALB/$c^{nu/nu}$ (CAnN.Cg-Foxn$1^{nu}$/Crl)), which lack T cells. BALB/c nude mice were inoculated subcutaneously with EMT6 cells. Starting 7 days post tumor inoculation (group mean tumor volumes between 80 $mm^3$ and 150 $mm^3$), mice were dosed three times weekly with (i) 10 mg/kg AIP-192482-mIgG2a, (ii) 20 mg/kg of AIP-192482-mIgG2a, or (iii) vehicle control (DPBS). Animals in all three treatment groups showed rapid progression of tumor volumes through Study Day 25, with no impact of AIP-192482-mIgG2a administration on tumor volumes.

Together, the data from both experiments indicate that T cells, most likely CD8+ T cells, are required for anti-tumor activity of AIP-192482-mIgG2a in mouse models.

Impact of AIP-192482-mIgG2a on the Tumor Microenvironment in the EMT6-BALB/c Syngeneic Mouse Tumor Model The impact of administration of the parental antibody AIP-192482-mIgG2a, on the TME was assessed in the EMT6-BALB/c syngeneic mouse tumor model in which AIP-192482-mIgG2a has anti-tumor activity.

As part of study EFF-004, TME was assessed by immunofluorescence in tumors harvested from mice dosed IP with 20 mg/kg AIP-192482-mIgG2a or vehicle (DPBS) on Days 7, 10, 14, 18, and 21. On Day 15, after administration of 3 doses of AIP-192482-mIgG2a or vehicle, the proportion of CD8+ T cells in tumors from mice dosed with AIP-192482-mIgG2a was significantly higher than in tumors from mice dosed with vehicle ($p<0.05$ by Fisher's Least Significant Difference test; (FIG. 62). Similarly, the proportion of iNOS (inducible nitric oxide synthase) positive, pro-inflammatory M1-polarized macrophages in tumors from mice dosed with AIP-192482-mIgG2a was significantly higher on Day 15 than in tumors from mice dosed with vehicle ($p<0.01$ by unpaired t-test; (FIG. 62).

On Day 22, after administration of 5 doses of AIP-192482-mIgG2a or vehicle, the proportion of CD4+FoxP3+ regulatory T cells (Treg) in tumors from mice dosed with AIP-192482-mIgG2a was significantly lower than in tumors harvested from mice that had been dosed with vehicle.

As part of one study (Study TMD04), in which BALB/c mice with established EMT6 tumors were dosed IP twice weekly with 10 mg/kg AIP-192482-mIgG2a or vehicle. In this study, most mice dosed with AIP-192482-mIgG2a were euthanized at study termination on Day 26 and most vehicle treatment mice were euthanized when they reach a tumor volume ≥2000 $mm^3$ between Days 25 and 27. Tumors were harvested after euthanasia and dissociated, and the resulting cell preparations were stained to evaluate the presence of lymphoid and myeloid subsets within the tumor by flow cytometry.

A significant increase was observed in the proportions of CD8+ T cells, CD4+ T cells, natural killer (NK) cells, dendritic cells, Treg, and monocytic myeloid-derived suppressor cells (M-MDSC) between tumors from mice dosed with AIP-192482-mIgG2a compared to tumors from mice dosed with vehicle. Conversely, F4/80+ macrophages and granulocytic myeloid-derived suppressor cell (G-MDSC) populations were reduced, each showing greater than 10-fold reductions in tumors from mice dosed with AIP-192482-mIgG2a compared to tumors from mice dosed with vehicle.

Together, the cell types identified by immunofluorescence on tissue specimens and by flow cytometry of cellular suspensions indicate that binding of the ATRC-101 target results in a change in the proportion and nature of lymphoid and myeloid cell populations in the TME from those predominantly associated with pro-tumorigenic and immune-suppressive properties towards those that are more closely associated with anti-tumorigenic, pro-inflammatory properties.

Secondary Pharmacodynamics

The specificity and selectivity of ATRC-101 were assessed using an arrayed cell expression screening system (Retrogenix, Whaley Bridge, High Peak, UK). Arrayed cell expression screening systems have been used for specificity assessments and target identification. The parental antibody AIP-192482, expressed as a human IgG1 (AIP-192482-hIgG1) evaluated in this study did not show background binding to the HEK293 cells used.

AIP-192482-hIgG1 was screened at a concentration of 2 μg/mL on arrayed fixed HEK293 cells each expressing one of the 3559 full-length human plasma membrane proteins. Duplicate arrays were probed in a primary screen as well as in a confirmatory/specificity screen. No specific binding of AIP-192482-hIgG1 to any of the expressed proteins was observed. The results indicate ATRC-101 does not bind specifically or selectively to any of the 3559 human plasma membrane proteins that constitute the library as tested.

Safety Pharmacology

ATRC-101 is a monoclonal antibody with a selective mechanism aimed to treat cancer patients and does not belong to a drug or chemical class expected to cause cardiovascular effects. As detailed in ICH guidelines S6 (R1), S7A, and S9, specific safety pharmacology studies are not required for biotechnology-derived products that achieve specific receptor targeting, such as monoclonal antibodies for anti-cancer pharmaceuticals.

Further, the mouse and cynomolgus monkey are not appropriate species for safety pharmacology or toxicology studies due to no, or very low, ATRC-101 target expression in normal tissues. Nevertheless, a 4-week exploratory intravenous toxicity study was conducted in cynomolgus monkeys and no non-target effects were observed (as evaluated by routine clinical observations, clinical pathology, cytokines, gross and microscopic evaluations) at ATRC-101 doses≤100 mg/kg (AUC range of 185000 to 186000 hr·μg/mL). There were also no target-related adverse effects observed (as evaluated by routine clinical observations, clinical pathology, cytokines, gross and microscopic evaluations) in an EMT6-BALB/c syngeneic tumor model at dose levels of ATRC-101 and MFC-042≤30 mg/kg (the highest serum concentration of 295 μg/mL and 290 μg/mL in tumor-bearing mice, respectively).

Based on immunoprecipitation and mass spectroscopy data, ATRC-101 recognizes a target that is a complex containing human polyadenylate-binding protein family member(s) and poly(A) RNA. ATRC-101 binds with nanomolar affinity to in vitro reconstituted complexes containing in vitro transcribed poly(A) RNA and (i) recombinant human/non-human primate PABPC-1 or (ii) recombinant mouse PABPC-1.

While PABPC-1 and poly(A) RNA are widely present in normal cells, the ATRC-101 target appears to be tumor-associated. Tumor-selective binding to ATRC-101 target was observed in a variety of human tumor types including NSCLC, breast cancer, CRC, ovarian cancer, and melanoma, where tumor cores were positive, but adjacent tissues were not. Similarly, the target of ATRC-101 is detected in mouse EMT6 tumor cores, but not adjacent tissues. Binding to mouse EMT6 tumor cells extracted from tumor cores is lost over time when these cells are cultured in vitro. In addition, binding to ATRC-101 target in human tumor cores was shown to be dependent on the RNase-sensitive component of the complex.

In normal human tissues, normal cynomolgus monkey tissues, and most normal mouse tissues, pharmacology assessments revealed no definitive ATRC-101 target binding. In a GLP tissue cross-reactivity study in normal human tissues, staining with ATRC-101 was observed in some human tissues. However, virtually all of the staining detected was cytoplasmic in nature with the singular exception of rare and sparse staining noted in the distal tubular epithelial cells of the human kidney. The findings are not considered to be toxicologically relevant.

Overall, the pharmacology and toxicology assessments indicate that the target of ATRC-101 is tumor-associated and that cell-surface localization is dependent on the context of tumor growth in vivo. The basis of the tumor-association of the ATRC-101 target and selectivity of ATRC-101 remain under study.

ATRC-101 and chimeric ATRC-101 variants show anti-tumor activity across EMT6, CT26, and E0771 syngeneic mouse tumor models, with no signs of toxicity. ATRC-101 variants show increased anti-tumor activity in combination with PD-1 blockade. Anti-tumor activity of ATRC-101 variants is dependent on Fc effector function and the presence of host T cells and is associated with anti-tumorigenic, pro-inflammatory changes in the TME. ATRC-101 does not appear to act through either ADCC or CDC mechanisms. ATRC-101 does not bind to human PBMCs in vitro and does not appear to cause cytokine release in PBMC and whole blood in vitro assays.

Based on these in vivo and in vitro observations, the clinical candidate ATRC-101 is proposed to cause tumor growth inhibition and regression, in part, by (a) altering the composition of the tumor microenvironment to be more anti-tumorigenic and pro-inflammatory, and (b) inducing an adaptive immune response that recruits effector CD8+ T cells to attack the tumors.

Based on the tumor-selective binding in human carcinomas and melanoma and anti-tumor activity in mouse models, ATRC-101 is selected for administration to a patient for treatment of advanced solid tumors.

Example 14. Toxicology

The nonclinical safety studies of ATRC-101 consisted of in vitro assessments of ATRC-101 utilizing human cells and tissues and in vivo animal studies in a mouse disease model to assess potential target related toxicity and in cynomolgus monkeys to address potential target-related toxicity and off-target toxicity, respectively. This nonclinical safety strategy is consistent with the recommendations detailed in ICH S6 (R1) as well as ICH S9 and is considered appropriate for evaluating the safety profile of ATRC-101. The scope of the toxicologic evaluation was appropriate to support its proposed clinical use for treatment of cancer.

The scope of the toxicologic evaluation of ATRC-101 demonstrated an acceptable safety profile and supports first-in-human dosing in cancer patients. The proposed human starting dose is 0.3 mg/kg, which is 8-fold lower than the NOAEL (30 mg/kg; human equivalent dose (HED)=2.4 mg/kg) in the EMT6 syngeneic breast cancer study and is expected to provide an adequate safety margin for the starting clinical dose.

The human tissue cross-reactivity study was conducted in compliance with GLP regulations. Non-GLP studies were conducted in accordance with the International Conference on Harmonization (ICH) guidelines using good scientific practices and following the applicable standard operation procedures (SOPs) of the Testing Facility and applicable Sites.

Single-Dose Toxicity

A single-dose toxicity study was not conducted. However, a single-dose IV bolus pharmacokinetic (PK) and tolerability study with a 4-week observation period was conducted in cynomolgus monkeys. In this study, administration of ATRC-101 was well tolerated in cynomolgus monkeys at dose levels up to 30 mg/kg.

Repeat-Dose Toxicity

Considering the ATRC-101 target is tumor-associated with no or very low expression in normal animal tissues, the potential target related toxicity of ATRC-101 was evaluated in a repeat-dose EMT6-BALB/c syngeneic breast cancer model. In addition, a non-GLP repeat-dose toxicity study in cynomolgus monkeys was conducted to evaluate the potential non-target related toxicity of ATRC-101.

Preclinical Efficacy and Safety Assessments of ATRC-101 and MFC-042 in Syngeneic Breast Cancer Model (Studies ATRC-101.PD.18.01 and ATRC-101.PD.18.02)

Safety parameters were incorporated in this preclinical efficacy and safety assessments study in the mouse EMT6-BALB/c syngeneic breast cancer model to evaluate the potential target-related toxicity of ATRC-101 and MFC-042 (harboring an identical human Fv region of ATRC-101 but expressed with a mouse IgG2a Fc region). This study was composed of two parts that were conducted concurrently: assessment of MFC-042 (Part A; ATRC-101.PD.18.01) and ATRC-101 (Part B; ATRC-101.PD.18.02).

In Part A of the study, seven groups of female BALB/c mice (15 animals/group) with established subcutaneous EMT6 tumors (group mean tumor volumes (MTVs)=112 to 113 $mm^3$) were dosed via IP injection with 0 (vehicle), 0.1, 0.3, 1, 3, 10, or 30 mg/kg MFC-042 on Days 1, 4, 8, 11, and 15. Two groups of non-tumor bearing (naïve) mice (15 animals/group) were treated with vehicle or 30 mg/kg MFC-042 at the same dose regimen. Animals were euthanized for necropsy examinations on Day 16.

In Part B of the study, four groups of female BALB/c mice (15 animals/group) with established subcutaneous EMT6 tumors (group MTV=108 $mm^3$) were dosed via IP injection with 0 (vehicle), 3, 10, or 30 mg/kg ATRC-101 on Days 1, 4, 8, 11, and 15. Two groups of naïve mice (15 animals/group) were treated with vehicle or 30 mg/kg ATRC-101 at the same dose regimen. Animals were euthanized for necropsy examinations on Day 16.

The parameters evaluated in this study included mortality/moribundity, clinical signs, body weights, overall efficacy assessments, clinical pathology (hematology and clinical chemistry), serum test article concentrations, serum cytokine analysis, gross necropsy findings, organ weights, and microscopic examinations (the brain, heart, lung, liver, kidney, pancreas, spleen, stomach, and lymph nodes, as well as tumor tissue in tumor-bearing animals).

Repeat doses of ATRC-101 at ≥10 mg/kg or MFC-042 at ≥3 mg/kg to tumor-bearing mice significantly inhibited the growth of EMT6-BALB/c syngeneic mammary tumors. In these groups, tumor growth inhibition, often with evidence of tumor regression, met or exceeded the threshold for potential therapeutic activity.

There was no ATRC-101 or MFC-042-related mortality in the study. There were no adverse clinical observations or effects on body weight related to ATRC-101 or MFC-042. No toxicologically significant effects were noted in hematology and clinical chemistry parameters. There were no gross pathology observations or notable changes in organ weights in mice euthanized on Day 16.

The cytokine levels and trends noted following the administration of ATRC-101 and MFC-042 were within the expected biologic response from the administration of human proteins to a mouse tumor model, and/or were related to anti-tumor activity of test articles and, therefore, were not considered adverse.

Microscopically, tumor masses collected at necropsy were composed of neoplastic cells arranged in streams and bundles. Overall, tumor masses were observed in all mice inoculated with EMT6 tumor cells. There were no ATRC-101 or MFC-042-related adverse microscopic findings at terminal euthanasia.

Repeat-dose IP administration of ATRC-101 at dose levels of 0, 1, 10, and 30 mg/kg or MFC-042 at dose levels of 0, 0.1, 0.3, 1, 3, 10, and 30 mg/kg, to naïve and EMT6 syngeneic breast cancer tumor-bearing female BALB/c mice was well-tolerated and no toxicologically significant effects were noted. Based on these safety assessment results, the NOAEL was considered to be 30 mg/kg for ATRC-101 and MFC-042 in naïve and EMT6 syngeneic breast cancer tumor-bearing female BALB/c mice. At this dose level, the highest serum concentrations of ATRC-101 were 295 μg/mL and 281 μg/mL in tumor-bearing mice and naïve mice, respectively; the highest serum concentrations of MFC-042 were 367 μg/mL and 533 μg/mL in tumor-bearing mice and naïve mice, respectively.

A 4-Week Dose Range-Finding Toxicology Study with ATRC-101 in Cynomolgus Monkeys (ATRC-101.TX.18.01)

The objective of this study was to determine the potential non-target related toxicity and toxicokinetics (TK) of ATRC-101 when administered by IV infusion (30 minutes in duration) once weekly for 4 weeks (Days 1, 8, 15, and 22) to cynomolgus monkeys. In the study, 8 naïve monkeys were randomly assigned to 4 groups (1 animal/sex/group). Animals were dosed once weekly with 0 (vehicle), 10, 30, or 100 mg/kg ATRC-101 via 30-minute IV infusion for 4 weeks (4 doses). The dose volume was 5 mL/kg.

The following parameters were evaluated in this study: mortality/moribundity, clinical signs, qualitative food consumption, body weights, clinical pathology (hematology, clinical chemistry, and urinalysis), cytokines, TK parameters, organ weights, macroscopic and microscopic examinations (20 organs/tissues, including the brain, heart, lung, liver, kidney, and pancreas).

In the TK evaluation, $C_{max}$ was generally observed at 0.75 hours ($T_{max}$) post the start of infusion (0.25 hours post the end of infusion). The terminal elimination phase was not characterized for any animals due to the relatively sustained concentrations observed after $T_{max}$. Systemic exposure increased with dose within the range tested. Though there was 1 animal/sex/group, the increase seemed to be approximately dose proportional. There was no notable gender-related difference in exposure. Following repeated administration, systemic exposure on Day 22 was generally higher compared to Day 1, with individual accumulation ratios ranging from 1.64 to 2.17.

Intravenous administration of ATRC-101 once weekly to cynomolgus monkeys for 4 weeks at doses of 0, 10, 30, or 100 mg/kg/week was well tolerated. All animals survived until terminal necropsy (Day 29). There were no ATRC-101-related changes in clinical signs, qualitative food consumption, body weights, clinical pathology parameters, or most cytokines. There were no ATRC-101-related gross pathology findings, definitive organ weight findings, or microscopic findings.

Administration of ATRC-101 by IV infusion once weekly for 4 weeks was well tolerated in cynomolgus monkeys at all dose levels administered: 10, 30, and 100 mg/kg/week. The NOAEL was considered to be 100 mg/kg/week, with associated $C_{max}$ values of 2410 μg/mL for males and 2690 μg/mL for females, and $AUC_{0-t}$ values of 185000 μg·hr/mL for males and 186000 μg·hr/mL for females on Day 22.

Local Tolerance

The local tolerance of ATRC-101 was assessed in the non-GLP 4-week repeat-dose toxicity study in cynomolgus monkeys (ATRC-101.TX.18.01). There was no clinical evidence of irritation or local tolerance issues at the ATRC-101 injection sites after repeat dosing (IV, once every week for 4 doses total) at doses up to 100 mg/kg with an ATRC-101 concentration of 20 mg/mL.

Other Toxicity Studies

Tissue Cross-Reactivity Study of ATRC-101 in Normal Human Tissues (ATRC-101.TX.19.01)

A GLP tissue cross-reactivity study in normal human tissues was conducted to evaluate potential cross-reactivity of ATRC-101 (2 and 10 μg/mL) with cryosections from a comprehensive panel of 34 normal human tissues (3 donors per tissue).

ATRC-101 produced weak to strong cytoplasm and cytoplasmic granule staining of rare positive control neoplastic cells in human mammary tumor 016327T2 at both concentrations. ATRC-101 did not specifically react with the negative control stromal fibroblasts in human mammary tumor 016327T2 at either staining concentration. The control article, human IgG1, did not specifically react with either the positive or negative control tissue elements. There also was no staining of the assay control slides. The specific reactions of ATRC-101 in all staining runs with the positive control material and the lack of specific reactivity with the negative control material, as well as the lack of reactivity of the control article, indicated that the assay was sensitive, specific, and reproducible.

Membrane and cytoplasmic staining with ATRC-101 were observed in tubular epithelium (weak-strong, rare) in the kidney. Cytoplastic staining was noted in epithelium (weak-strong, variably frequent) in the Fallopian tube (mucosa), pancreas (ducts, acini), salivary gland (acini), thyroid (follicles, parafollicular cells), and uterus (endometrium); mononuclear cells (weak-moderate, rare) in the small intestine; myoepithelium (weak-moderate, rare-occasional) in the breast; islet cells (weak-moderate, very rare) in the pancreas; neurons (weak-intense, rare-occasional) in the brain (cerebellum, cerebrum) and spinal cord; retinal cells (weak-strong, occasional) in the outer plexiform layer in the eye; cells/processes associated with peripheral nerves (weak-strong, very rare-occasional) in the bladder, breast, eye, gastrointestinal tract (esophagus, small intestine [ganglion cells]), skin, spinal cord (spinal nerve roots), striated (skeletal) muscle; pituicytes (weak-moderate, frequent) in the pituitary neurohypophysis. The subcellular localization of the neuropil staining (weak-moderate, frequent) in the human brain (cerebellum, cerebrum) could not be identified at the resolution of a light microscope.

In summary, staining with ATRC-101 was observed in some human tissues. However, virtually all of the staining with ATRC-101 was cytoplasmic in nature, and monoclonal antibody binding to cytoplasmic sites in tissue cross-reactivity studies generally is considered of little to no toxicologic significance due to the limited ability of antibody drugs to access the cytoplasmic compartment in vivo (Hall et al, 2008; Leach et al, 2010). Membrane staining with ATRC-101 was restricted to rare (1-5% of cells) tubular epithelial cells in the human kidney. Therefore, this staining is not anticipated to be toxicologically significant. The subcellular localization of the neuropil staining in the human brain could not be identified at the resolution of a light microscope; however, this staining is not anticipated to be toxicologically significant as this tissue element is protected by the blood-brain barrier.

Nonclinical Toxicology Findings

ATRC-101 binds to a tumor-associated version of a complex containing a polyadenylate-binding protein family member and poly(A) RNA. This antibody is considered to pose a low risk of triggering cytokine release in humans based on in vitro human PBMC binding and cytokine release study results. A comprehensive battery of non-clinical toxicity studies was performed to establish the toxicologic profile of ATRC-101.

The potential target-related toxicity of ATRC-101 was evaluated in a preclinical efficacy and safety study in the syngeneic EMT6-BALB/c breast cancer mouse model. In this study, administration of ATRC-101 at dose levels of 0, 1, 10 and 30 mg/kg or MFC-042 (identical human Fv region of ATRC-101 on a mouse IgG2a Fc region) at dose levels of 0, 0.1, 0.3, 1, 3, 10 and 30 mg/kg, to naïve and EMT6-BALB/c syngeneic breast cancer tumor-bearing mice was well-tolerated and no toxicologically significant effects were noted. The NOAEL was considered to be 30 mg/kg for ATRC-101 and MFC-042 in naïve and tumor-bearing female BALB/c mice. At this dose level, the highest serum concentrations of ATRC-101 were 295 μg/mL and 281 μg/mL in tumor-bearing mice and naïve mice, respectively; the highest serum concentrations of MFC-042 were 367 μg/mL and 533 μg/mL in tumor-bearing mice and naïve mice, respectively.

The potential non-target-related toxicity of ATRC-101 was evaluated in a 4-week repeat-dose toxicity study in cynomolgus monkeys. Administration of ATRC-101 by IV infusion once weekly for 4 weeks was well tolerated in cynomolgus monkeys at all dose levels administered: 10, 30, and 100 mg/kg/week. The NOAEL was considered to be 100 mg/kg/week, with $C_{max}$ values of 2410 μg/mL for males and 2690 μg/mL for females, and $AUC_{0-t}$ values of 185000 μg·hr/mL/mL for males and 186000 μg·hr/mL for females on Day 22.

In a GLP tissue cross-reactivity study in normal human tissues, staining with ATRC-101 was observed in some human tissues. However, virtually all of the staining was cytoplasmic in nature and is not a toxicological concern because it is unlikely that ATRC-101 will cross cell membranes or interact directly with components of the cytoplasm. Membrane associated staining with ATRC-101 was restricted to rare (1-5% of cells) tubular epithelial cells in the human kidney. Given the rarity of staining frequency, this staining is not anticipated to be toxicologically significant. Furthermore, ATRC-101 (i) does not appear to mediate either ADCC or CDC, (ii) binding of ATRC-101 to its target was not found to trigger or abrogate any signal transduction pathways, (iii) and any potential renal toxicity will be monitored by urinalysis and clinical chemistry in the proposed clinical trial. Taken together the membrane staining noted on rare tubular epithelial cells in the in vitro tissue cross-reactivity study is considered to be a low risk for patient safety.

Collectively, the results of the non-clinical toxicology studies demonstrate an acceptable safety profile and support progression of ATRC-101 into clinical studies in cancer patients.

Human Dose Rationale

The scientific rationale for choosing the human starting dose of 0.3 mg/kg is based on an integrated evaluation of all available ATRC-101 nonclinical pharmacology, PK, and toxicology data, as well as the available literature. At the proposed human starting dose of 0.3 mg/kg the $C_{max}$ is expected to be approximately 7.81 μg/mL and the $AUC_{0-672h}$ is expected to be 53.1 day·μg/mL based on ATRC-101 human dose simulations.

The proposed 0.3 mg/kg starting dose provides a substantial safety margin from the NOAEL dose of 30 mg/kg determined in the repeat-dose preclinical efficacy and safety study in EMT6 breast cancer tumor-bearing female BALB/c mice. The human starting dose of 0.3 mg/kg is ⅛ of the NOAEL (30 mg/kg in mice=2.44 mg/kg human equivalent dose). This provides a safety margin of approximately 47-fold to the expected $C_{max}$ (7.81 μg/mL) in human at the proposed starting dose of 0.3 mg/kg.

Example 15. Pharmacokinetics

In the single-dose PK study, 6 naïve cynomolgus monkeys (3 males and 3 females) were randomly assigned to 3 dose groups and administered ATRC-101 at 1, 10, or 30 mg/kg via intravenous (IV) bolus injection. Animals were observed for 28 days following the administration of ATRC-101. Serum samples were collected at different timepoints and analysed by an Enzyme-Linked Immunosorbent Assay (ELISA) method for the determination of ATRC-101 concentration.

Following a single IV administration, maximum serum concentrations ($C_{max}$) were observed between 0.083 and 1 hour post-dose except for the female at 1 mg/kg where it was observed at 8 hour post-dose. Half-lives ($T_{1/2}$) ranged from 177 to 225 hours. The apparent clearance rate (CL) and the apparent volume of distribution (Vd) ranged between 0.159 and 0.436 mL/hr/kg and between 51.4 and 117 mL/kg, respectively. Systemic exposure increased with dose within the range tested. The increase was approximately dose proportional except for the females between 1 and 10 mg/kg where the increase was lower than dose proportional. There was no notable gender-related difference in exposure except at 1 mg/kg where female exposure was 2-fold higher compared to that of male.

The toxicokinetic (TK) profile of ATRC-101 was evaluated in a 4-week repeat-dose IV toxicity study in cynomolgus monkeys. Eight (8) naïve animals (4 males and 4 females) were given once weekly IV infusion (30 minutes) of ATRC-101 at 0, 10, 30, or 100 mg/kg for a total of 4 doses. Serum samples were collected at different timepoints and analysed by an ELISA method. Maximum serum concentrations was generally observed at 0.75 hours post the start of infusion (SOI). The terminal elimination phase was not characterized for any animals due to the relatively sustained concentrations observed after the time of $C_{max}$ ($T_{max}$). Systemic exposure increased with dose within the range tested and the increase was approximately dose proportional. There was no notable gender-related difference in exposure. Following repeated administration, systemic exposure on Day 22 was generally higher compared to Day 1, with individual accumulation ratios ranging from 1.64 to 2.17.

LC-MS/MS Method for Measuring ATRC-101 Concentration in BALB/c Mouse Serum (ATRC-101.PD.18.02)

ATRC-101 concentration in BALB/c mouse serum was determined using a liquid chromatography-tandem mass spectrometry (LC-MS/MS) method. In the method, PEP-1, a signature peptide digested from ATRC-101, was measured to determine the concentration of ATRC-101 (the concentration of PEP-1 is equivalent to that of ATRC-101). In this assay, each 10 μL aliquot of standard, quality control (QC) sample, or study sample was mixed with 25 μL of working internal standard solution (25 μg/mL in water), 15 μL of water, and 150 μL of SMART Digestion buffer (Thermo Fisher Scientific, Waltham, Mass., USA). The samples were briefly centrifuged and a 200 μL aliquot of the resulting supernatant was transferred to SMART Digestion microtubes. The samples were vortexed and incubated at 65° C. while shaking for 2 hours. A 200 μL aliquot of reaction mixture was mixed with 5 μL of 20% sodium bisulfate. The reaction was quenched with 5 μL of neat formic acid. Samples were vortexed and centrifuged. A 150 μL aliquot of the resulting supernatant was transferred to a clean 96-well low-binding plate. An aliquot was injected onto an LC-MS/MS system for analysis. The liquid chromatography system used a Phenomenex XB-C18 column, 1.0×50 mm (2.7 μm particle size) with a gradient flow consisting of water/formic acid (100/0.5, v/v) and acetonitrile/formic acid (100/0.5, v/v) at a flow rate of 0.600 mL/minute. The signature peptide and internal standard were detected using a Waters Xevo TQ-S triple quadrupole LC-MS/MS system equipped with an ESI (TurbolonSpray®) ionization source operated in the positive ion mode. This method was applicable to quantitation within nominal concentration ranges of 2 to 250 μg/mL for ATRC-101 from a 10-μL BALB/c mouse serum aliquot.

ELISA Method for Measuring ATRC-101 Concentration in Cynomolgus Monkey Serum (ATRC-101.PK.18.01)

ATRC-101 concentration in cynomolgus monkey serum was determined using an ELISA method. This assay employed a quantitative immunoassay technique. Briefly, microtiter plates were coated with sheep anti-human IgG to capture ATRC-101. The assay was calibrated using a standard curve generated from eleven standards within range prepared using the human antibody, ATRC-101 at concentrations of 800, 400, 300, 200, 150, 100, 75, 50, 30, 20, 10 ng/mL, including anchor points at 10 and 800 ng/mL, in neat cynomolgus monkey serum. The QC samples were prepared in serum at a concentration of 250, 175, and 40 ng/mL of ATRC-101 in neat cynomolgus monkey serum. The data regression from the microplate reader was performed using Watson LIMS, version 7.3.0.01. A 4-parameter model was used to fit the sigmoid calibration curve, with a weighting equation of $1/y^2$. Standards, QC samples, and study samples were analyzed with an minimum required dilution of 5-fold and sample concentrations in neat monkey serum (μg/mL) were determined. One set of QC samples was prepared before and after preparation of standards, test samples, and blank. Detection of ATRC-101 was accomplished with goat anti-human IgG (heavy and light chains) conjugated to horse radish peroxidase. Tetramethylbenzidine was used as the chromogenic substrate. The range of quantification of the method was 20-400 ng/Ml.

The absorption of ATRC-101 was characterized in a single-dose IV bolus PK study and a repeat-dose IV infusion toxicity study in cynomolgus monkeys. Monkey serum concentration of ATRC-101 was determined by an ELISA method.

In the single-dose pharmacokinetic study, 6 naïve cynomolgus monkeys (3 males and 3 females) were randomly assigned to 3 dose groups and administered ATRC-101 at 1, 10, or 30 mg/kg via IV bolus injection. $T_{max}$ was generally observed between 0.083 and 1 hour post-dose. $T_{1/2}$ ranged from 177 to 225 hours. CL and Vd ranged between 0.15 and 0.436 mL/hr/kg and 51.4 and 117 mL/kg, respectively.

Systemic exposure to ATRC-101 increased with dose within the range tested and the increase was approximately dose proportional.

In the 4-week repeat-dose IV toxicokinetic study in cynomolgus monkeys, 8 naïve animals (4 males and 4 females) were randomly assigned to 4 dose groups and given once weekly IV infusion (30 minutes) of ATRC-101 at 0, 10, 30, or 100 mg/kg for a total of 4 doses. $T_{max}$ was generally observed at 0.75 hours post SOI. The terminal elimination phase was not characterized for any animals due to the relatively sustained concentrations observed after $T_{max}$. Systemic exposure increased with dose within the range tested and the increase was approximately dose proportional. There was no notable gender-related difference in exposure. Following repeated administration, systemic exposure on Day 22 was generally higher compared to Day 1, with individual accumulation ratios ranging from 1.64 to 2.17.

A Single Dose Intravenous Bolus Pharmacokinetic Study of ATRC-101 in Cynomolgus Monkeys with a 4-Week Observation Period (ATRC-101.PK.18.01)

The objective of this study was to evaluate the PK of ATRC-101 in cynomolgus monkeys following a single IV bolus dose administration.

In this study, 6 naïve animals (1 animal/sex/group) were randomly assigned into 3 groups and administered ATRC-101 at 1, 10, or 30 mg/kg once by IV bolus injection. ATRC-101 was formulated in 20 mM histidine, 8% sucrose, 0.02% polysorbate 80 at pH 6.0 and further diluted to the target concentration for dosing. The dose volume was 3.0 mL/kg. Pharmacokinetic samples were collected on Day 1 at pre-dose, 5 minutes, 1, 4, 8, 12, 24, 48, 96, 168, 240, 336, 504, and 672 hours post-dose. Serum concentrations of ATRC-101 were determined by an ELISA method.

Figure 63:
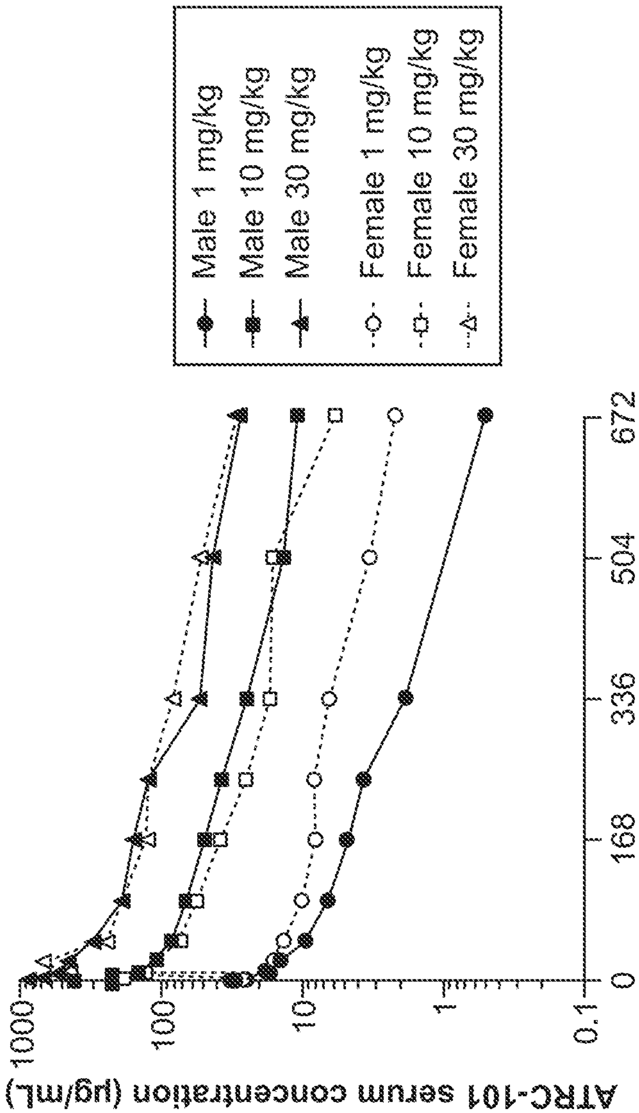

Parameters in this study included survival, clinical observations, body weights, body temperature, clinical pathology (hematology and serum chemistry), and PK analysis. All animals survived to the end of study. No ATRC-101-related clinical signs were observed. There were no ATRC-101-related findings in body weights, body temperature, or clinical pathology. Serum concentrations of ATRC-101 were below the lower limit of quantification (LLOQ=20 ng/mL) in all samples collected at the pre-dose timepoint for the treated groups. Following administration of ATRC-101 on Day 1, ATRC-101 was quantifiable throughout the 672-hour sampling period for the dose levels evaluated. FIG. 63. The concentration in the female given 1 mg/kg at 8 hours post-dose was higher compared to that at 10 mg/kg (241 μg/mL vs. 129 μg/mL, respectively).

Following administration of ATRC-101, $T_{max}$ were observed between 0.083 and 1 hour post-dose except for the female at 1 mg/kg dose level where the maximum concentration was observed at 8 hours post-dose. Maximum serum concentrations were followed by a decline of ATRC-101 with $T_{1/2}$ ranging from 177 to 225 hours. The CL and Vd ranged between 0.159 and 0.436 mL/hr/kg and between 51.4 and 117 mL/kg, respectively.

Systemic exposure to ATRC-101, as defined by $C_{max}$ and the area under the curve from time 0 to time of analysis ($AUC_{0-t}$), increased with dose within the range tested. The increase seemed to be approximately dose proportional for the dose levels evaluated except for the females between 1 and 10 mg/kg where the increase was lower than dose proportional. There was no notable gender-related difference in exposure except at 1 mg/kg dose level where female exposure seemed to be 2-fold higher compared to that of male.

A 4-Week Dose Range-Finding Toxicology Study with ATRC-101 in Cynomolgus Monkeys (ATRC-101.TX.18.01)

The objective of this study was to evaluate the potential non-target related toxicity and TK of ATRC-101 when administered by IV infusion once weekly for 4 weeks to cynomolgus monkeys.

In this study, 8 naïve monkeys were randomly assigned to 4 groups (1 animal/sex/group). Animals were dosed once weekly with 0 (vehicle), 10, 30, or 100 mg/kg ATRC-101 via 30-minute IV infusion for 4 weeks (4 doses). The dose volume was 5 mL/kg. Toxicokinetic samples were collected at a series of timepoints on Days 1 and 22. Serum concentrations of ATRC-101 were determined by an ELISA method.

Serum concentrations of ATRC-101 were below LLOQ (20 ng/mL) in all pre-dose samples collected at Day −7, in all samples collected in the control group on Days 1 and 22, and in all samples at the pre-dose timepoint for the treated groups on Day 1. Following administration of ATRC-101 on Days 1 and 22, ATRC-101 was quantifiable through the 168-hour sampling period for all dose levels. ATRC-101 serum concentrations in ATRC-101 treatment groups are shown in FIG. 64.

Following administration of ATRC-101, $T_{max}$ was observed between 0.75 and 4.5 hours post SOI, corresponding to 0.25 and 4 hours post end of infusion (EOI), with most cases falling at 0.75 hours post SOI (0.25 hours post EOI). The terminal elimination phase was not characterized for any animals due to the relatively sustained concentrations observed after $T_{max}$.

Systemic exposure to ATRC-101, as defined by $C_{max}$ and $AUC_{0-t}$, increased with dose within the range tested. Considering that there was 1 animal/sex/group, the increase seemed to be approximately dose proportional. There was no notable gender-related difference in exposure. Following repeated administration, systemic exposure on Day 22 was generally higher compared to Day 1, with individual accumulation ratios ranging from 1.64 to 2.17.

PK modeling approach was used to predict PK parameters of ATRC-101 in human. The observed systemic concentrations versus time of ATRC-101 in study ATRC-101.PK.18.01 were modeled with a standard 2-compartment PK model and allometrically scaled to human based on body weight. Simulations were performed to obtain predicted human serum time courses after doses of 0.1, 0.3, 1, 3, 10, and 30 mg/kg administered once every three weeks over 6 weeks. Human exposure metrics were predicted following a single IV administration. At a concentration of 0.3 mg/kg the $C_{max}$ in human is estimated to reach 7.81 μg/mL and the $AUC_{0-672hr}$ is estimated to be 53.1 day·μg/mL.

The projected human PK parameters were correlated to the relevant concentrations from in vitro pharmacology studies of activity in the Target and Effector Dual Engagement Assay. In the Target and Effector Dual Engagement Assay, the half-maximal effective concentration ($EC_{50}$) of ATRC-101 was shown to be 68 nM. The dose response curves of ATRC-101 in this assay were fit to a four-parameter logistic regression model to assess effective concentrations ($EC_{20}$, $EC_{50}$, and $EC_{80}$. A dose level of 0.3 mg/kg in humans was estimated to result in a $C_{max}$ (7.81 μg/mL) below $EC_{50}$ and achieve a 20% maximal effective concentration ($EC_{20}$) for approximately 6 days (~33% of dosing interval; based on the Target and Effector Dual Engagement Assay.

Following a single IV bolus administration to cynomolgus monkeys at dose levels of 1, 10, and 30 mg/kg, $T_{max}$ was observed between 0.083 and 1 hour post-dose except for the female at 1 mg/kg where it was observed at 8 hours post-dose. The $T_{1/2}$ ranged from 177 to 225 hours. The CL and Vd ranged between 0.15 and 0.436 mL/hr/kg and 51.4 and 117 mL/kg, respectively. Systemic exposure to ATRC-101 increased with dose within the range tested and the increase seemed to be approximately dose proportional except for the females between 1 and 10 mg/kg where the increase was lower than dose proportional. There was no notable gender-related difference in exposure except at 1 mg/kg dose level where female exposure seemed to be 2-fold higher compared to that of male.

In the 4-week repeat-dose toxicity and TK study, $T_{max}$ was generally observed at 0.75 hours post SOI following once weekly administration via 30 minute IV infusion at 10, 30, and 100 mg/kg/week. The terminal elimination phase was not characterized for any animals due to the relatively sustained concentrations observed after $T_{max}$. Systemic exposure increased with dose within the range tested and the increase seemed to be approximately dose proportional. There was no notable gender-related difference in exposure. Following repeated administration, systemic exposure on Day 22 was generally higher compared to Day 1, with individual accumulation ratios ranging from 1.64 to 2.17.

Collectively, these data indicate that the PK profile of ATRC-101 is typical for a human IgG1 monoclonal antibody. Data from the single dose PK study in cynomolgus monkey was used to predict the PK parameters of ATRC-101 in humans. At a dose of 0.3 mg/kg ATRC-101 the $C_{max}$ in human is estimated to reach 7.81 µg/mL and the $AUC_{0-672hr}$ is estimated to be 53.1 day·µg/mL.

In accordance with regulatory guidelines, no metabolism, tissue distribution, or excretion studies with ATRC-101 have been conducted in animals. As a typical monoclonal antibody, ATRC-101 is expected to degrade into small peptides and amino acids via biochemical pathways that are independent of drug metabolizing enzymes, such as cytochromes P450 enzymes, so no drug-drug interactions are anticipated.

It is understood that the examples and embodiments described herein are for illustrative purposes only and that various modifications or changes in light thereof will be suggested to persons skilled in the art and are to be included within the spirit and purview of this application and scope of the appended claims. All publications, patents, accession numbers, and patent applications cited herein are hereby incorporated by reference for the purposes in the context of which they are cited.

TABLE 1A

| | AIP Number | $V_H$ Sequence | $V_L$ Sequence |
|---|---|---|---|
| 1 | AIP-101235 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRSGSCPSSDTSYCNGQYKSYYYMDVWGKGTTVTVSS (SEQ ID NO: 77) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 123) |
| 2 | AIP-127782 | EVQLVESGGGLVQPGGSLRLSCAASGFTFSKAWMSWVRQAPGKGLEWVGRIKSVTDGETTEYAASVKGRFTISRDDSKNSLYLQMNSLKTEDTAVYYCTSSFCCRGGSCPSHDTSYCGGQYKSYYYMDVWGKGTTVTVSS (SEQ ID NO: 78) | QSVLTQPPSVSAAPGQKVTISCSGSSSNIGSSSVSWYQQLPGTAPKLLIYKNNQRPSGIPDRFSGSKSGTSATLGITGLQTGDEADYYCSTWDDSLSVRVFGGGTKLTVL (SEQ ID NO: 124) |
| 3 | AIP-189473 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFCCRGASCPSSDTSYCAGSYKSYYFVNIWGKGTTVTVSS (SEQ ID NO: 79) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 125) |
| 4 | AIP-192571 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGNQCPSSDTSYCGGQYPSYYYMDPWGKGTTVTVSS (SEQ ID NO: 80) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 126) |
| 5 | AIP-125258 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCRGKQCPSSDTSYCNGYYADYYFMDVWGKGTTVTVSS (SEQ ID NO: 81) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 127) |
| 6 | AIP-150199 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCRGKQCPSSDTSYCGGQFKSYYFMDVWGKGTTVTVSS (SEQ ID NO: 82) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 128) |
| | | | QSVLTQPPSASGTPGQRVTISCSGSSSNI |

TABLE 1A-continued

| | AIP Number | $V_H$ Sequence | $V_L$ Sequence |
|---|---|---|---|
| 7 | AIP-115388 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCHSNNCPSSDTSYCNGYYKQYYFMDVWGKGTTVTVSS (SEQ ID NO: 83) | GSSSVSWYQQLPGTAPKLLIYKNNQRPSGVPDRFSGSKSGTSASLAISGLRSEDEADYYCSTWDDSLSVRVFGGGTKLTVL (SEQ ID NO: 129) |
| 8 | AIP-143369 | EVQLVESGGALVKPGGSLRLSCAASGFTYSAAWMSWVRQAPGKGLEWVGRIKAVHDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 84) | QSVLTQPPSASGTPGQRVTISCSGSSTNIGSSSVTWYQQLPGTAPKLLIYKDNQRPLGVPDRFSGSKSGTSASLAISGLRSEDEADYYCSTWDDSLSVRVFGGGTKLTVL (SEQ ID NO: 130) |
| 9 | AIP-157045 | EVQLVESGGALVKPGGSLRLSCAASGFTFSMAWMSWVRQAPGKGLEWVGRIKSNTDAETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 85) | QSVLTQPPSASGTPGQRVTISCSGSKSNIGSSYVSWYQQLPGTAPKLLIYMNNQRPYGVPDRFSGSKSGTSASLAISGLRSEDEADYYCATWDDQLSVRVFGGGTKLTVL (SEQ ID NO: 131) |
| 10 | AIP-175775 | EVQLVESGGALVKPGGSLRLSCAASGFTFSAAWMSWVRQAPGKGLEWVGRIKSVTDGETTDYAAPVKGRFTISRDDSKSTLYLQMNSLKTEDTAVYYCISSFCCRGNSCPSSDTSYCNGQYKSYYYMDVWGKGTTVTVSS (SEQ ID NO: 86) | QSVLTQPPSASGTPGQRVTISCSGSKSNIGSSSVSWYQQLPGTAPKLLIYKDNQRPSGVPDRFSGSKSGTSASLAISGLRSEDEADYYCATWDNSLSIRVFGGGTKLTVL (SEQ ID NO: 132) |
| 11 | AIP-154181 | EVQLVESGGALVKPGGSLRLSCAASGFTYSKAWMSWVRQAPGKGLEWVGRIKSVQDGETTDYAAPVKGRFTISRDDSKSTLYLQMNSLKTEDTAVYYCTSSFCCRGGSCPSHDTSYCGGQYKSFYYMDVWGKGTTVTVSS (SEQ ID NO: 87) | QSVLTQPPSASGTPGQRVTISCSGASSNIGSSSVSWYQQLPGTAPKLLIYKNIQRASGVPDRFSGSKSGTSASLAISGLRSEDEADYYCSSWDDSNSVRIFGGGTKLTVL (SEQ ID NO: 133) |
| 12 | AIP-125984 | EVQLVESGGALVKPGGSLRLSCAASGFTFAKAWMSWVRQAPGKGLEWVGRIKSVTDGHTTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 88) | QSVLTQPPSASGTPGQRVTISCSGSSTNIGSSTVSWYQQLPGTAPKLLIYKNNARPYGVPDRFSGSKSGTSASLAISGLRSEDEADYYCATWDDSLTVRIFGGGTKLTVL (SEQ ID NO: 134) |
| 13 | AIP-160829 | EVQLVESGGALVKPGGSLRLSCAASGFVFSKAWMSWVRQAPGKGLEWVGRIKSVTDGGITDYAAPVKGRFTISRDDSKSTLYLQMNSLKTEDTAVYYCISSFCCRGNSCPSSDTSYCNGQYKSYYFMDVWGKGTTVTVSS (SEQ ID NO: 89) | QSVLTQPPSASGTPGQRVTISCSGASSNIGSSSVSWYQQLPGTAPKLLIYKNTQRPSGVPDRFSGSKSGTSASLAISGLRSEDEADYYCATWDDQLSVRVFGGGTKLTVL (SEQ ID NO: 135) |
| 14 | AIP-184744 | EVQLVESGGALVKPGGSLRLSCAASGFTFSAAWMSWVRQAPGKGLEWVGRIKSTSDGETTDYAAPVKGRFTISRDDSKSTLYLQMNSLKTEDTAVYYCISSFCCRGGSCPSRDTSYCGGQYKSYYFMDVWGKGTTVTVSS (SEQ ID NO: 90) | QSVLTQPPSASGTPGQRVTISCSGSSTNIGSSSVSWYQQLPGTAPKLLIYKDNQRPSGVPDRFSGSKSGTSASLAISGLRSEDEADYYCSSWDDSNSVRIFGGGTKLTVL (SEQ ID NO: 136) |
| 15 | AIP-128136 | EVQLVESGGALVKPGGSLRLSCAASGFTFSKAWMSWVRQAPGKGLEWVGRIKSVQDGETTDYAAPVKGRFTISRDDSKSTLYLQMNSLKTEDTAVYYCTSSFCCRGGSCPSSDTSYCGGYYKSYYFMDVWGKGTTVTVSS (SEQ ID NO: 91) | QSVLTQPPSASGTPGQRVTISCSGSKSNIGSSSVYWYQQLPGTAPKLLIYKNNQRPYGVPDRFSGSKSGTSASLAISGLRSEDEADYYCSTWDDALSVRVFGGGTKLTVL (SEQ ID NO: 137) |
| 16 | AIP-181273 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVY | QSVLTQPPSASGTPGQRVTISCSGSSSNIGSSSVYWYQQLPGTAPKLLIYKNNQRPSGVPDRFSGSKSGTSASLAISGLRSEDEADYYCSTWDDALSVRVFGGGTKLTVL (SEQ |

TABLE 1A-continued

| | AIP Number | $V_H$ Sequence | $V_L$ Sequence |
|---|---|---|---|
| | | YCTSSFCCRGGSCPSSDTSYCGGQ YKSYYFMDVWGKGTTVTVSS (SEQ ID NO: 92) | ID NO: 138) |
| 17 | AIP-153125 | EVQLVESGGALVKPGGSLRLSCAA SGFTFSKAWMSWVRQAPGKGLEWV GRIKSVQDGETTDYAAPVKGRFTI SRDDSKSTLYLQMNSLKTEDTAVY YCTSSFCCRGGSCPSHDTSYCGGY YKSYYYMDVWGKGTTVTVSS (SEQ ID NO: 93) | QSVLTQPPSASGTPGQRVTISCSGSKSNI GSSYVSWYQQLPGTAPKLLIYKNNQRPYG VPDRFSGSKSGTSASLAISGLRSEDEADY YCSTWDDSLSVRVFGGGTKLTVL (SEQ ID NO: 139) |
| 18 | AIP-160470 | EVQLVESGGALVKPGGSLRLSCAA SGFTFSKAWMSWVRQAPGKGLEWV GRIKSVTDGETTDYAAPVKGRFTI SRDDSKSTLYLQMNSLKTEDTAVY YCTSSFCCRGGSCPSHDTSYCGGQ YKSYYYMDVWGKGTTVTVSS (SEQ ID NO: 94) | QSVLTQPPSASGTPGQRVTISCSGSSSNI GSSSVSWYQQLPGTAPKLLIYKNNQRPSG VPDRFSGSKSGTSASLAISGLRSEDEADY YCSTWDDSLSVRVFGGGTKLTVL (SEQ ID NO: 140) |
| 19 | AIP-192482 | EVQLVESGGALVKPGGSLRLSCAA SGFTFSKAWMTWVRQAPGKGLEWV GRIKSVTDGETTDYAAPVKGRFTI SRDDSKSVLYLQMSSLKTEDTAVY FCTSSFCCRGGSCPSHDTSFCGGQ DKRYYYMDVWGKGTTVTVSS (SEQ ID NO: 95) | QSVLTQAPSASETPGQRVIISCSGSSSNI GSSSVSWYQQLPGTAPKLLIYKNNQRPSG VPDRFSGSKSGTSASLAISGLRSEDEADY YCSTWDDSLSVRVFGGGTKLTVL (SEQ ID NO: 141) |
| 20 | AIP-171142 | EVQLVESGGGLVKPGGSLRLSCAA SGFTFSKAWMTWVRQAPGKGLEWV GRIKSVTDGETTDYAAPVKGRFTI SRDDSKNTLYLQMNSLKTEDTAVY YCTTSFCCRGGSCPSHDTSFCGGQ DKRYYYMDVWGQGTTVTVSS (SEQ ID NO: 96) | QSVLTQPPSASGTPGQRVTISCSGSSSNI GSSSVSWYQQLPGTAPKLLIYKNNQRPSG VPDRFSGSKSGTSASLAISGLRSEDEADY YCSTWDDSLSVRVFGGGTKLTVL (SEQ ID NO: 142) |
| 21 | AIP-157397 | EVQLVESGGALVKPGGSLRLSCAA SGFTFSKAWMTWVRQAPGKGLEWV GRIKSVTDGETTDYAAPVKGRFTI SRDDSKSVLYLQMSSLKTEDTAVY FCTSSFCCRGGSCPSHDTSFCGGQ YNRYYYMDVWGKGTTVTVSS (SEQ ID NO: 97) | QSVLTQAPSASETPGQRVIISCSGSSSNI GSSSVSWYQQLPGTAPKLLIYKNNQRPSG VPDRFSGSKSGTSASLAISGLRSEDEADY YCSTWDDSLSVRVFGGGTKLTVL (SEQ ID NO: 143) |
| 22 | AIP-165430 | EVQLVESGGALVKPGGSLRLSCAA SGFTFSKAWMTWVRQAPGKGLEWV GRIKSVTDGETTDYAAPVKGRFTI SRDDSKSVLYLQMSSLKTEDTAVY FCTSSFCCRGGSCPSHDTSFCGGQ YKSYYYMDVWGKGTTVTVSS (SEQ ID NO: 98) | QSVLTQAPSASETPGQRVIISCSGSSSNI GSSSVSWYQQLPGTAPKLLIYKNNQRPSG VPDRFSGSKSGTSASLAISGLRSEDEADY YCSTWDDSLSVRVFGGGTKLTVL (SEQ ID NO: 144) |
| 23 | AIP-189526 | EVQLVESGGGLVKPGGSLRLSCAA SGFTFSKAWMTWVRQAPGKGLEWV GRIKSTSDGGITDYAAPVKGRFTI SRDDSKNTLYLQMNSLKTEDTAVY YCTTSFCCRGGRCPSRDTSFCGGQ YNSYYYMDVWGQGTTVTVSS (SEQ ID NO: 99) | QSVLTQPPSASGTPGQRVTISCSGSSSNI GSSSVSWYQQLPGTAPKLLIYKNNQRPSG VPDRFSGSKSGTSASLAISGLRSEDEADY YCSTWDDSLSVRVFGGGTKLTVL (SEQ ID NO: 145) |
| 24 | AIP-122563 | EVQLVESGGALVKPGGSLRLSCAA SGFTFSKAWMTWVRQAPGKGLEWV GRIKSVTDGETTDYAAPVKGRFTI SRDDSKSTLYLQMNSLKTEDTAVY YCTSSFCCRGGSCPSHDTSFCGGQ DKRYYYMDVWGKGTTVTVSS (SEQ ID NO: 100) | QSVLTQPPSASGTPGQRVTISCSGSSSNI GSSSVSWYQQLPGTAPKLLIYKNNQRPSG VPDRFSGSKSGTSASLAISGLRSEDEADY YCSTWDDSLSVRVFGGGTKLTVL (SEQ ID NO: 146) |
| 25 | AIP-158623 | EVQLVESGGALVKPGGSLRLSCAA SGFTFSKAWMTWVRQAPGKGLEWV GRIKSVTDGETTDYAAPVKGRFTI SRDDSKSTLYLQMNSLKTEDTAVY YCTSSFCCRGGSCPSHDTSFCGGQ YKSYYYMDVWGKGTTVTVSS (SEQ ID NO: 101) | QSVLTQPPSASGTPGQRVTISCSGSSSNI GSSSVSWYQQLPGTAPKLLIYKNNQRPSG VPDRFSGSKSGTSASLAISGLRSEDEADY YCSTWDDSLSVRVFGGGTKLTVL (SEQ ID NO: 147) |

TABLE 1A-continued

| | AIP Number | $V_H$ Sequence | $V_L$ Sequence |
|---|---|---|---|
| 26 | AIP-155066 | EVQLVESGGGLVKPGGSLRLSCAASGFTFSKAWMTWVRQAPGKGLEWVGRIKSVTDGETTDYAAPVKGRFTISRDDSKNTLYLQMNSLKTEDTAVYYCTTSFCCRGGSCPSHDTSFCGGQYKSYYYMDVWGQGTTVTVSS (SEQ ID NO: 102) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 148) |
| 27 | AIP-136538 | EVQLVESGGALVKPGGSLRLSCAASGFTFSKAWMTWVRQAPGKGLEWVGRIKSVTDGETTDYAAPVKGRFTISRDDSKSTLYLQMNSLKTEDTAVYYCTSSFCCRGGSCPSHDTSFCGGQDSRYYYMDVWGKGTTVTVSS (SEQ ID NO: 103) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 149) |
| 28 | AIP-166120 | EVQLVESGGALVKPGGSLRLSCAASGFTFSKAWMTWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 104) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 150) |
| 29 | AIP-133645 | EVQLVESGGALVKPGGSLRLSCAASGFTFSKAWMTWVRQAPGKGLEWVGRIKSVTDGETTDYAAPVKGRFTISRDDSKSTLYLQMNSLKTEDTAVYYCTSSFCCRGGSCPSHDTSFCGGQYKSYYYMDVWGKGTTVTVSS (SEQ ID NO: 105) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDESLSVRVFGGGTKLTVL (SEQ ID NO: 151) |
| 30 | AIP-187893 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSFCGGQYKSYYYMDVWGKGTTVTVSS (SEQ ID NO: 106) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 152) |
| 31 | AIP-142079 | EVQLVESGGALVKPGGSLRLSCAASGFTFSKAWMTWVRQAPGKGLEWVGRIKSVTDGETTDYAAPVKGRFTISRDDSKSTLYLQMNSLKTEDTAVYYCTSSFCCRGGSCPSHDTSFCGGSYKSYYYMDVWGKGTTVTVSS (SEQ ID NO: 107) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 153) |
| 32 | AIP-104188 | EVQLVESGGALVKPGGSLRLSCAASGFTFSKAWMTWVRQAPGKGLEWVGRIKSVTDGETTDYAAPVKGRFTISRDDSKSTLYLQMNSLKTEDTAVYYCTSSFCCRGGSCPSHDTSYCGGQDSRYYYMDVWGKGTTVTVSS (SEQ ID NO: 108) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDESLSVRVFGGGTKLTVL (SEQ ID NO: 154) |
| 33 | AIP-106042 | EVQLVESGGGLVKPGGSLRLSCAASGFTFSKAWMTWVRQAPGKGLEWVGRIKSVTEGETTDYAAPVKGRFTISRDDSKNTLYLQMNSLKTEDTAVYYCTTSFCCRGGSCPSHDTSFCGGQYKSYYYMDVWGQGTTVTVSS (SEQ ID NO: 109) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDESLSVRVFGGGTKLTVL (SEQ ID NO: 155) |
| 34 | AIP-100196 | EVQLVESGGALVKPGGSLRLSCAASGFTFSKAWMTWVRQAPGKGLEWVGRIKSVTEGETTDYAAPVKGRFTISRDDSKSTLYLQMNSLKTEDTAVYYCTSSFCCRGGSCPSHDTSFCGGQYKSYYYMDVWGKGTTVTVSS (SEQ ID NO: 110) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDESLSVRVFGGGTKLTVL (SEQ ID NO: 156) |

TABLE 1A-continued

| | AIP Number | $V_H$ Sequence | $V_L$ Sequence |
|---|---|---|---|
| 35 | AIP-180675 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYFMDVWGKGTTVTVSS (SEQ ID NO: 111) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 157) |
| 36 | AIP-170105 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 112) | QSVLTQPPSASGTPGQRVTISCSGSSSNIGSSSVYWYQQLPGTAPKLLIYKNNQRPSGVPDRFSGSKSGTSASLAISGLRSEDEADYYCSTWDDSLSVRVFGGGTKLTVL (SEQ ID NO: 158) |
| 37 | AIP-126080 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQNKQYYYMDVWGKGTTVTVSS (SEQ ID NO: 113) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 159) |
| 38 | AIP-161571 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGNCPSHETSYCGNQYKSYYYMDVWGKGTTVTVSS (SEQ ID NO: 114) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 160) |
| 39 | AIP-181246 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYVNIWGKGTTVTVSS (SEQ ID NO: 115) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 161) |
| 40 | AIP-192216 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFCCRGASCPSHDTSYCAGSYKSYYYMDVWGKGTTVTVSS (SEQ ID NO: 116) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 162) |
| 41 | AIP-168605 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 117) | QSVLTQPPSASGTPGQRVTISCSGSSSDIGSSSVSWYQQLPGTAPKLLIYKNNQRPSGVPDRFSGSKSGTSASLAISGLRSEDEADYYCSTWNDALSVRVFGGGTKLTVL (SEQ ID NO: 163) |
| 42 | AIP-172872 | EVQLVESGGALVKPGGSLRLSCAASGFTFSKAWMSWVRQAPGKGLEWVGRIKSVTDGEQTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 118) | QSVLTQPPSASGTPGQRVTISCSGSSSNIGSSSVSWYQQLPGTAPKLLIYKNTQRPSGVPDRFSGSKSGTSASLAISGLRSEDEADYYCSTWDDSLNVRVFGGGTKLTVL (SEQ ID NO: 164) |
| 43 | AIP-190051 | EVQLVESGGALVKPGGSLRLSCAASGFTFSKAWMTWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 119) | QSVLTQPPSASGTPGQRVTISCSGSPSNIGSSSVSWYQQLPGTAPKLLIYKNNQRPSGVPDRFSGSKSGTSASLAISGLRSEDEADYYCSTWDDALSVRVFGGGTKLTVL (SEQ ID NO: 165) |

TABLE 1A-continued

| | AIP Number | $V_H$ Sequence | $V_L$ Sequence |
|---|---|---|---|
| 44 | AIP-167533 | EVQLVESGGALVKPGGSLRLSCAASGFTFSKAWMSWVRQAPGKGLEWVGRIKAADDGKQTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 120) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 166) |
| 45 | AIP-112580 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCRGNSCPSSDTSYCNGQYKSYYYMDVWGKGTTVTVSS (SEQ ID NO: 121) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 167) |
| 46 | AIP-136060 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 122) | QSVLTQPPSASGTPGQRVTISCSGSSSNIGSSSVSWYQQLPGTAPKLLIYKNSLRPQGVPDRFSGSKSGTSASLAISGLRSEDEADYYCSTWDDSLSVRVFGGGTKLTVL (SEQ ID NO: 168) |

TABLE 1B

| | AIP Number | HCDR1 | HCDR2 | HCDR3 | LCDR1 | LCDR2 | LCDR3 |
|---|---|---|---|---|---|---|---|
| 1 | AIP-101235 | GFTFSKAWMS (SEQ ID NO: 1) | RIKSVTDGETTDYAAPVKG (SEQ ID NO: 9) | TSSFCCRSGSCPSSDTSYCNGQYKSYYYMDV (SEQ ID NO: 20) | SGSSSNIGSSSVS (SEQ ID NO: 48) | KNNQRPS (SEQ ID NO: 59) | STWDDSLSVRV (SEQ ID NO: 68) |
| 2 | AIP-127782 | GFTFSKAWMS (SEQ ID NO: 1) | RIKSVTDGETEYAASVKG (SEQ ID NO: 504) | TSSFCCRGGSCPSHDTSYCGGQYKSYYYMDV (SEQ ID NO: 21) | SGSSSNIGSSSVS (SEQ ID NO: 48) | KNNQRPS (SEQ ID NO: 59) | STWDDSLSVRV (SEQ ID NO: 68) |
| 3 | AIP-189473 | GFTFSKAWMS (SEQ ID NO: 1) | RIKSVTDGETTDYAAPVKG (SEQ ID NO: 9) | TTSFCCRGASCPSSDTSYCAGSYKSYYFVNI (SEQ ID NO: 22) | SGSSSNIGSSSVS (SEQ ID NO: 48) | KNNQRPS (SEQ ID NO: 59) | STWDDSLSVRV (SEQ ID NO: 68) |
| 4 | AIP-192571 | GFTFSKAWMS (SEQ ID NO: 1) | RIKSVTDGETTDYAAPVKG (SEQ ID NO: 9) | TSSFCCRGNQCPSSDTSYCGGQYPSYYYMDP (SEQ ID NO: 23) | SGSSSNIGSSSVS (SEQ ID NO: 48) | KNNQRPS (SEQ ID NO: 59) | STWDDSLSVRV (SEQ ID NO: 68) |
| 5 | AIP-125258 | GFTFSKAWMS (SEQ ID NO: 1) | RIKSVTDGETTDYAAPVKG (SEQ ID NO: 9) | ISSFCCRGKQCPSSDTSYCNGYYADYYFMDV (SEQ ID NO: 24) | SGSSSNIGSSSVS (SEQ ID NO: 48) | KNNQRPS (SEQ ID NO: 59) | STWDDSLSVRV (SEQ ID NO: 68) |
| 6 | AIP-150199 | GFTFSKAWMS (SEQ ID NO: 1) | RIKSVTDGETTDYAAPVKG (SEQ ID NO: 9) | ISSFCCRGKQCPSSDTSYCGGQFKSYYFMDV (SEQ ID NO: 25) | SGSSSNIGSSSVS (SEQ ID NO: 48) | KNNQRPS (SEQ ID NO: 59) | STWDDSLSVRV (SEQ ID NO: 68) |
| 7 | AIP-115388 | GFTFSKAWMS (SEQ ID NO: 1) | RIKSVTDGETTDYAAPVKG (SEQ ID NO: 9) | ISSFCCHSNNCPSSDTSYCNGYYKQYYFMDV (SEQ ID NO: 26) | SGSSSNIGSSSVS (SEQ ID NO: 48) | KNNQRPS (SEQ ID NO: 59) | STWDDSLSVRV (SEQ ID NO: 68) |

TABLE 1B-continued

| | AIP Number | HCDR1 | HCDR2 | HCDR3 | LCDR1 | LCDR2 | LCDR3 |
|---|---|---|---|---|---|---|---|
| 8 | AIP-143369 | GFTYSAAWMS (SEQ ID NO: 2) | RIKAVHDGETTDYAAPVKG (SEQ ID NO: 10) | TSSFCCRGGSCPSHDTSYCGGQYKSYYYMDV (SEQ ID NO: 21) | SGSSTNIGSSSVT (SEQ ID NO: 49) | KDNQRPL (SEQ ID NO: 60) | STWDDSLSVRV (SEQ ID NO: 68) |
| 9 | AIP-157045 | GFTFSMAWMS (SEQ ID NO: 3) | RIKSNTDAETTDYAAPVKG (SEQ ID NO: 11) | TSSFCCRGGSCPSHDTSYCGGQYKSYYYMDV (SEQ ID NO: 21) | SGSKSNIGSSYVS (SEQ ID NO: 50) | MNNQRPY (SEQ ID NO: 61) | ATWDDQLSVRV (SEQ ID NO: 69) |
| 10 | AIP-175775 | GFTFSAAWMS (SEQ ID NO: 4) | RIKSVTDGETTDYAAPVKG (SEQ ID NO: 9) | ISSFCCRGNSCPSSDTSYCNGQYKSYYYMDV (SEQ ID NO: 27) | SGSKSNIGSSSVS (SEQ ID NO: 51) | KDNQRPS (SEQ ID NO: 62) | ATWDNSLSIRV (SEQ ID NO: 70) |
| 11 | AIP-154181 | GFTYSKAWMS (SEQ ID NO: 5) | RIKSVQDGETTDYAAPVKG (SEQ ID NO: 12) | TSSFCCRGGSCPSHDTSYCGGQYKSFYYMDV (SEQ ID NO: 28) | SGASSNIGSSSVS (SEQ ID NO: 52) | KNTQRAS (SEQ ID NO: 63) | SSWDDSNSVRI (SEQ ID NO: 71) |
| 12 | AIP-125984 | GFTFAKAWMS (SEQ ID NO: 6) | RIKSVTDGHTTDYAAPVKG (SEQ ID NO: 13) | TSSFCCRGGSCPSHDTSYCGGQYKSYYYMDV (SEQ ID NO: 21) | SGSSTNIGSSTVS (SEQ ID NO: 53) | KNNARPY (SEQ ID NO: 64) | ATWDDSLTVRI (SEQ ID NO: 76) |
| 13 | AIP-160829 | GFVFSKAWMS (SEQ ID NO: 7) | RIKSVTDGGITDYAAPVKG (SEQ ID NO: 14) | ISSFCCRGNSCPSSDTSYCNGQYKSYYFMDV (SEQ ID NO: 29) | SGASSNIGSSSVS (SEQ ID NO: 52) | KNTQRPS (SEQ ID NO: 65) | ATWDDQLSVRV (SEQ ID NO: 69) |
| 14 | AIP-184744 | GFTFSAAWMS (SEQ ID NO: 4) | RIKSTSDGETTDYAAPVKG (SEQ ID NO: 15) | ISSFCCRGGSCPSRDTSYCGGQYKSYYFMDV (SEQ ID NO: 30) | SGSSTNIGSSSVS (SEQ ID NO: 54) | KDNQRPS (SEQ ID NO: 62) | SSWDDSNSVRI (SEQ ID NO: 71) |
| 15 | AIP-128136 | GFTFSKAWMS (SEQ ID NO: 1) | RIKSVQDGETTDYAAPVKG (SEQ ID NO: 12) | TSSFCCRGGSCPSSDTSYCGGYYKSYYFMDV (SEQ ID NO: 31) | SGSKSNIGSSSVY (SEQ ID NO: 55) | KNNQRPY (SEQ ID NO: 66) | STWDDALSVRV (SEQ ID NO: 72) |
| 16 | AIP-181273 | GFTFSKAWMS (SEQ ID NO: 1) | RIKSVTDGETTDYAAPVKG (SEQ ID NO: 9) | TSSFCCRGGSCPSSDTSYCGGQYKSYYFMDV (SEQ ID NO: 32) | SGSSSNIGSSSVY (SEQ ID NO: 56) | KNNQRPS (SEQ ID NO: 59) | STWDDALSVRV (SEQ ID NO: 72) |
| 17 | AIP-153125 | GFTFSKAWMS (SEQ ID NO: 1) | RIKSVQDGETTDYAAPVKG (SEQ ID NO: 12) | TSSFCCRGGSCPSHDTSYCGGYYKSYYYMDV (SEQ ID NO: 33) | SGSKSNIGSSYVS (SEQ ID NO: 50) | KNNQRPY (SEQ ID NO: 66) | STWDDSLSVRV (SEQ ID NO: 68) |
| 18 | AIP-160470 | GFTFSKAWMS (SEQ ID NO: 1) | RIKSVTDGETTDYAAPVKG (SEQ ID NO: 9) | TSSFCCRGGSCPSHDTSYCGGQYKSYYYMDV (SEQ ID NO: 21) | SGSSSNIGSSSVS (SEQ ID NO: 48) | KNNQRPS (SEQ ID NO: 59) | STWDDSLSVRV (SEQ ID NO: 68) |
| 19 | AIP-192482 | GFTFSKAWMT (SEQ ID NO: 8) | RIKSVTDGETTDYAAPVKG (SEQ ID NO: 9) | TSSFCCRGGSCPSHDTSFCGGQDKRYYYMDV (SEQ ID NO: 34) | SGSSSNIGSSSVS (SEQ ID NO: 48) | KNNQRPS (SEQ ID NO: 59) | STWDDSLSVRV (SEQ ID NO: 68) |
| 20 | AIP-171142 | GFTFSKAWMT (SEQ ID NO: 8) | RIKSVTDGETTDYAAPVKG (SEQ ID NO: 9) | TTSFCCRGGSCPSHDTSFCGGQDKRYYYMDV (SEQ ID NO: 35) | SGSSSNIGSSSVS (SEQ ID NO: 48) | KNNQRPS (SEQ ID NO: 59) | STWDDSLSVRV (SEQ ID NO: 68) |

TABLE 1B-continued

| | AIP Number | HCDR1 | HCDR2 | HCDR3 | LCDR1 | LCDR2 | LCDR3 |
|---|---|---|---|---|---|---|---|
| 21 | AIP-157397 | GFTFSKAWMT (SEQ ID NO: 8) | RIKSVTDGETTDYAAPVKG (SEQ ID NO: 9) | TSSFCCRGGSCPSHDTSFCGGQYNRYYYMDV (SEQ ID NO: 36) | SGSSSNIGSSSVS (SEQ ID NO: 48) | KNNQRPS (SEQ ID NO: 59) | STWDDSLSVRV (SEQ ID NO: 68) |
| 22 | AIP-165430 | GFTFSKAWMT (SEQ ID NO: 8) | RIKSVTDGETTDYAAPVKG (SEQ ID NO: 9) | TSSFCCRGGSCPSHDTSFCGGQYKSYYYMDV (SEQ ID NO: 37) | SGSSSNIGSSSVS (SEQ ID NO: 48) | KNNQRPS (SEQ ID NO: 59) | STWDDSLSVRV (SEQ ID NO: 68) |
| 23 | AIP-189526 | GFTFSKAWMT (SEQ ID NO: 8) | RIKSTSDGGITDYAAPVKG (SEQ ID NO: 16) | TTSFCCRGGRCPSRDTSFCGGQYNSYYYMDV (SEQ ID NO: 38) | SGSSSNIGSSSVS (SEQ ID NO: 48) | KNNQRPS (SEQ ID NO: 59) | STWDDSLSVRV (SEQ ID NO: 68) |
| 24 | AIP-122563 | GFTFSKAWMT (SEQ ID NO: 8) | RIKSVTDGETTDYAAPVKG (SEQ ID NO: 9) | TSSFCCRGGSCPSHDTSFCGGQDKRYYYMDV (SEQ ID NO: 34) | SGSSSNIGSSSVS (SEQ ID NO: 48) | KNNQRPS (SEQ ID NO: 59) | STWDDSLSVRV (SEQ ID NO: 68) |
| 25 | AIP-158623 | GFTFSKAWMT (SEQ ID NO: 8) | RIKSVTDGETTDYAAPVKG (SEQ ID NO: 9) | TSSFCCRGGSCPSHDTSFCGGQYKSYYYMDV (SEQ ID NO: 37) | SGSSSNIGSSSVS (SEQ ID NO: 48) | KNNQRPS (SEQ ID NO: 59) | STWDDSLSVRV (SEQ ID NO: 68) |
| 26 | AIP-155066 | GFTFSKAWMT (SEQ ID NO: 8) | RIKSVTDGETTDYAAPVKG (SEQ ID NO: 9) | TTSFCCRGGSCPSHDTSFCGGQYKSYYYMDV (SEQ ID NO: 39) | SGSSSNIGSSSVS (SEQ ID NO: 48) | KNNQRPS (SEQ ID NO: 59) | STWDDSLSVRV (SEQ ID NO: 68) |
| 27 | AIP-136538 | GFTFSKAWMT (SEQ ID NO: 8) | RIKSVTDGETTDYAAPVKG (SEQ ID NO: 9) | TSSFCCRGGSCPSHDTSFCGGQDSRYYYMDV (SEQ ID NO: 40) | SGSSSNIGSSSVS (SEQ ID NO: 48) | KNNQRPS (SEQ ID NO: 59) | STWDDSLSVRV (SEQ ID NO: 68) |
| 28 | AIP-166120 | GFTFSKAWMT (SEQ ID NO: 8) | RIKSVTDGETTDYAAPVKG (SEQ ID NO: 9) | TSSFCCRGGSCPSHDTSYCGGQYKSYYYMDV (SEQ ID NO: 21) | SGSSSNIGSSSVS (SEQ ID NO: 48) | KNNQRPS (SEQ ID NO: 59) | STWDDSLSVRV (SEQ ID NO: 68) |
| 29 | AIP-133645 | GFTFSKAWMT (SEQ ID NO: 8) | RIKSVTDGETTDYAAPVKG (SEQ ID NO: 9) | TSSFCCRGGSCPSHDTSFCGGQYKSYYYMDV (SEQ ID NO: 37) | SGSSSNIGSSSVS (SEQ ID NO: 48) | KNNQRPS (SEQ ID NO: 59) | STWDESLSVRV (SEQ ID NO: 73) |
| 30 | AIP-187893 | GFTFSKAWMS (SEQ ID NO: 1) | RIKSVTDGETTDYAAPVKG (SEQ ID NO: 9) | TSSFCCRGGSCPSHDTSFCGGQYKSYYYMDV (SEQ ID NO: 37) | SGSSSNIGSSSVS (SEQ ID NO: 48) | KNNQRPS (SEQ ID NO: 59) | STWDDSLSVRV (SEQ ID NO: 68) |
| 31 | AIP-142079 | GFTFSKAWMT (SEQ ID NO: 8) | RIKSVTDGETTDYAAPVKG (SEQ ID NO: 9) | TSSFCCRGGSCPSHDTSFCGGSYKSYYYMDV (SEQ ID NO: 41) | SGSSSNIGSSSVS (SEQ ID NO: 48) | KNNQRPS (SEQ ID NO: 59) | STWDDSLSVRV (SEQ ID NO: 68) |
| 32 | AIP-104188 | GFTFSKAWMT (SEQ ID NO: 8) | RIKSVTDGETTDYAAPVKG (SEQ ID NO: 9) | TSSFCCRGGSCPSHDTSYCGGQDSRYYYMDV (SEQ ID NO: 42) | SGSSSNIGSSSVS (SEQ ID NO: 48) | KNNQRPS (SEQ ID NO: 59) | STWDESLSVRV (SEQ ID NO: 73) |
| 33 | AIP-106042 | GFTFSKAWMT (SEQ ID NO: 8) | RIKSVTEGETTDYAAPVKG (SEQ ID NO: 17) | TTSFCCRGGSCPSHDTSFCGGQYKSYYYMDV (SEQ ID NO: 39) | SGSSSNIGSSSVS (SEQ ID NO: 48) | KNNQRPS (SEQ ID NO: 59) | STWDESLSVRV (SEQ ID NO: 73) |

TABLE 1B-continued

| | AIP Number | HCDR1 | HCDR2 | HCDR3 | LCDR1 | LCDR2 | LCDR3 |
|---|---|---|---|---|---|---|---|
| 34 | AIP-100196 | GFTFSKAWMT (SEQ ID NO: 8) | RIKSVTEGETTDYAAPVKG (SEQ ID NO: 17) | TSSFCCRGGSCPSHDTSFCGGQYKSYYYMDV (SEQ ID NO: 37) | SGSSSNIGSSSVS (SEQ ID NO: 48) | KNNQRPS (SEQ ID NO: 59) | STWDESLSVRV (SEQ ID NO: 73) |
| 35 | AIP-180675 | GFTFSKAWMS (SEQ ID NO: 1) | RIKSVTDGETTDYAAPVKG (SEQ ID NO: 9) | TSSFCCRGGSCPSHDTSYCGGQYKSYYFMDV (SEQ ID NO: 43) | SGSSSNIGSSSVS (SEQ ID NO: 48) | KNNQRPS (SEQ ID NO: 59) | STWDDSLSVRV (SEQ ID NO: 68) |
| 36 | AIP-170105 | GFTFSKAWMS (SEQ ID NO: 1) | RIKSVTDGETTDYAAPVKG (SEQ ID NO: 9) | TSSFCCRGGSCPSHDTSYCGGQYKSYYYMDV (SEQ ID NO: 21) | SGSSSNIGSSSVY (SEQ ID NO: 56) | KNNQRPS (SEQ ID NO: 59) | STWDDSLSVRV (SEQ ID NO: 68) |
| 37 | AIP-126080 | GFTFSKAWMS (SEQ ID NO: 1) | RIKSVTDGETTDYAAPVKG (SEQ ID NO: 9) | TSSFCCRGGSCPSHDTSYCGGQNKQYYYMDV (SEQ ID NO: 44) | SGSSSNIGSSSVS (SEQ ID NO: 48) | KNNQRPS (SEQ ID NO: 59) | STWDDSLSVRV (SEQ ID NO: 68) |
| 38 | AIP-161571 | GFTFSKAWMS (SEQ ID NO: 1) | RIKSVTDGETTDYAAPVKG (SEQ ID NO: 9) | TSSFCCRGGNSGCPSHETSYCGNQYKSYYYMDV (SEQ ID NO: 45) | SSSNIGSSSVS (SEQ ID NO: 48) | KNNQRPS (SEQ ID NO: 59) | STWDDSLSVRV (SEQ ID NO: 68) |
| 39 | AIP-181246 | GFTFSKAWMS (SEQ ID NO: 1) | RIKSVTDGETTDYAAPVKG (SEQ ID NO: 9) | TSSFCCRGGSCPSHDTSYCGGQYKSYYYVNI (SEQ ID NO: 46) | SGSSSNIGSSSVS (SEQ ID NO: 48) | KNNQRPS (SEQ ID NO: 59) | STWDDSLSVRV (SEQ ID NO: 68) |
| 40 | AIP-192216 | GFTFSKAWMS (SEQ ID NO: 1) | RIKSVTDGETTDYAAPVKG (SEQ ID NO: 9) | TTSFCCRGASCPSHDTSYCAGSYKSYYYMDV (SEQ ID NO: 47) | SGSSSNIGSSSVS (SEQ ID NO: 48) | KNNQRPS (SEQ ID NO: 59) | STWDDSLSVRV (SEQ ID NO: 68) |
| 41 | AIP-168605 | GFTFSKAWMS (SEQ ID NO: 1) | RIKSVTDGETTDYAAPVKG (SEQ ID NO: 9) | TSSFCCRGGSCPSHDTSYCGGQYKSYYYMDV (SEQ ID NO: 21) | SGSSSDIGSSSVS (SEQ ID NO: 57) | KNNQRPS (SEQ ID NO: 59) | STWNDALSVRV (SEQ ID NO: 74) |
| 42 | AIP-172872 | GFTFSKAWMS (SEQ ID NO: 1) | RIKSVIDGEQTDYAAPVKG (SEQ ID NO: 18) | TSSFCCRGGSCPSHDTSYCGGQYKSYYYMDV (SEQ ID NO: 21) | SGSSSNIGSSSVS (SEQ ID NO: 48) | KNTQRPS (SEQ ID NO: 65) | STWDDSLNVRV (SEQ ID NO: 75) |
| 43 | AIP-190051 | GFTFSKAWMT (SEQ ID NO: 8) | RIKSVTDGETTDYAAPVKG (SEQ ID NO: 9) | TSSFCCRGGSCPSHDTSYCGGQYKSYYYMDV (SEQ ID NO: 21) | SGSPSNIGSSSVS (SEQ ID NO: 58) | KNNQRPS (SEQ ID NO: 59) | STWDDALSVRV (SEQ ID NO: 72) |
| 44 | AIP-167533 | GFTFSKAWMS (SEQ ID NO: 1) | RIKAADDGKQTDYAAPVKG (SEQ ID NO: 19) | TSSFCCRGGSCPSHDTSYCGGQYKSYYYMDV (SEQ ID NO: 21) | SGSSSNIGSSSVS (SEQ ID NO: 48) | KNNQRPS (SEQ ID NO: 59) | STWDDSLSVRV (SEQ ID NO: 68) |
| 45 | AIP-112580 | GFTFSKAWMS (SEQ ID NO: 1) | RIKSVTDGETTDYAAPVKG (SEQ ID NO: 9) | ISSFCCRGNSCPSSDTSYCNGQYKSYYYMDV (SEQ ID NO: 27) | SGSSSNIGSSSVS (SEQ ID NO: 48) | KNNQRPS (SEQ ID NO: 59) | STWDDSLSVRV (SEQ ID NO: 68) |

TABLE 1B-continued

| | AIP Number | HCDR1 | HCDR2 | HCDR3 | LCDR1 | LCDR2 | LCDR3 |
|---|---|---|---|---|---|---|---|
| 46 | AIP-136060 | GFTFSKAWMS (SEQ ID NO: 1) | RIKSVTDGETTDYAAPVKG (SEQ ID NO: 9) | TSSFCCRGGSCPSHDTSYCGGQYKSYYYMDV (SEQ ID NO: 21) | SGSSSNIGSSSVS (SEQ ID NO: 48) | KNSLRPQ (SEQ ID NO: 67) | STWDDSLSVRV (SEQ ID NO: 68) |

TABLE 2A

| | AIP Number | $V_H$ Sequence | $V_L$ Sequence |
|---|---|---|---|
| 1 | AIP-148327 | EVQLVESGGALVKPGGSLRLSCAASGFTFSKAWMTWVRQAPGKGLEWVGRIKSVTEGETTDYAAPVKGRFTISRDDSKSVLYLQMSSLKTEDTAVYFCTSSFCCRGGSCPSHDTSFCGGQDKRYYYMDVWGKGTTVTVSS (SEQ ID NO: 1333) | QSVLTQAPSASETPGQRVIISCSGSSSNIGSSSVSWYQQLPGTAPKLLIYKNNQRPSGVPDRFSGSKSGTSASLAISGLRSEDEADYYCSTWDESLSVRVFGGGTKLTVL (SEQ ID NO: 1527) |
| 2 | AIP-198092 | EVQLVESGGALVKPGGSLRLSCAASGFTFSKAWMTWVRQAPGKGLEWVGRIKSVTEGETTDYAAPVKGRFTISRDDSKSTLYLQMNSLKTEDTAVYYCTSSFCCRGGSCPSHDTSFCGGQDKRYYYMDVWGKGTTVTVSS (SEQ ID NO: 1334) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDESLSVRVFGGGTKLTVL (SEQ ID NO: 1528) |
| 3 | AIP-184490 | EVQLVESGGALVKPGGSLRLSCAASGFTFSKAWMTWVRQAPGKGLEWVGRIKSVTDGETTDYAAPVKGRFTISRDDSKSTLYLQMNSLKTEDTAVYYCTSSFCCRGGSCPSHDTSFCGGSYKSYYYMDVWGKGTTVTVSS (SEQ ID NO: 1335) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDESLSVRVFGGGTKLTVL (SEQ ID NO: 1529) |
| 4 | AIP-102396 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1336) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDESLSVRVFGGGTKLTVL (SEQ ID NO: 1530) |
| 5 | AIP-150055 | EVQLVESGGALVKPGGSLRLSCAASGYTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1337) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1531) |
| 6 | AIP-167084 | EVQLVESGGALVKPGGSLRLSCAASGFDFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1338) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1532) |
| 7 | AIP-185304 | EVQLVESGGALVKPGGSLRLSCAASGFVFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1339) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1533) |
| 8 | AIP-134770 | EVQLVESGGALVKPGGSLRLSCAASGFTYSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1340) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1534) |

TABLE 2A-continued

| | AIP Number | $V_H$ Sequence | $V_L$ Sequence |
|---|---|---|---|
| 9 | AIP-141887 | EVQLVESGGALVKPGGSLRLSCAA SGFTFAKAWMSWVRQAPGKGLEWV GRIKSVTDGETTDYAAPVKGRFTI SRDDSKSTLYLQMNSLKTEDTAVY YCTSSFCCRGGSCPSHDTSYCGGQ YKSYYYMDVWGKGTTVTVSS (SEQ ID NO: 1341) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1535) |
| 10 | AIP-196203 | EVQLVESGGALVKPGGSLRLSCAA SGFTFSNAWMSWVRQAPGKGLEWV GRIKSVTDGETTDYAAPVKGRFTI SRDDSKSTLYLQMNSLKTEDTAVY YCTSSFCCRGGSCPSHDTSYCGGQ YKSYYYMDVWGKGTTVTVSS (SEQ ID NO: 1342) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1536) |
| 11 | AIP-184151 | EVQLVESGGALVKPGGSLRLSCAA SGFTFSRAWMSWVRQAPGKGLEWV GRIKSVTDGETTDYAAPVKGRFTI SRDDSKSTLYLQMNSLKTEDTAVY YCTSSFCCRGGSCPSHDTSYCGGQ YKSYYYMDVWGKGTTVTVSS (SEQ ID NO: 1343) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1537) |
| 12 | AIP-128195 | EVQLVESGGALVKPGGSLRLSCAA SGFTFSMAWMSWVRQAPGKGLEWV GRIKSVTDGETTDYAAPVKGRFTI SRDDSKSTLYLQMNSLKTEDTAVY YCTSSFCCRGGSCPSHDTSYCGGQ YKSYYYMDVWGKGTTVTVSS (SEQ ID NO: 1344) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1538) |
| 13 | AIP-116579 | EVQLVESGGALVKPGGSLRLSCAA SGFTFSAAWMSWVRQAPGKGLEWV GRIKSVTDGETTDYAAPVKGRFTI SRDDSKSTLYLQMNSLKTEDTAVY YCTSSFCCRGGSCPSHDTSYCGGQ YKSYYYMDVWGKGTTVTVSS (SEQ ID NO: 1345) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1539) |
| 14 | AIP-192329 | EVQLVESGGALVKPGGSLRLSCAA SGFTFSHAWMSWVRQAPGKGLEWV GRIKSVTDGETTDYAAPVKGRFTI SRDDSKSTLYLQMNSLKTEDTAVY YCTSSFCCRGGSCPSHDTSYCGGQ YKSYYYMDVWGKGTTVTVSS (SEQ ID NO: 1346) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1540) |
| 15 | AIP-192329 | EVQLVESGGALVKPGGSLRLSCAA SGFTFSHAWMSWVRQAPGKGLEWV GRIKSVTDGETTDYAAPVKGRFTI SRDDSKSTLYLQMNSLKTEDTAVY YCTSSFCCRGGSCPSHDTSYCGGQ YKSYYYMDVWGKGTTVTVSS (SEQ ID NO: 1347) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1541) |
| 16 | AIP-197809 | EVQLVESGGALVKPGGSLRLSCAA SGFTFSKAYMSWVRQAPGKGLEWV GRIKSVTDGETTDYAAPVKGRFTI SRDDSKSTLYLQMNSLKTEDTAVY YCTSSFCCRGGSCPSHDTSYCGGQ YKSYYYMDVWGKGTTVTVSS (SEQ ID NO: 1348) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1542) |
| 17 | AIP-142489 | EVQLVESGGALVKPGGSLRLSCAA SGFTFSKAWFSWVRQAPGKGLEWV GRIKSVTDGETTDYAAPVKGRFTI SRDDSKSTLYLQMNSLKTEDTAVY YCTSSFCCRGGSCPSHDTSYCGGQ YKSYYYMDVWGKGTTVTVSS (SEQ ID NO: 1349) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1543) |

TABLE 2A-continued

| | AIP Number | $V_H$ Sequence | $V_L$ Sequence |
|---|---|---|---|
| 18 | AIP-148102 | EVQLVESGGALVKPGGSLRLSCAASGFTFSKAWMSWVRQAPGKGLEWVGRIQSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1350) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1544) |
| 19 | AIP-167726 | EVQLVESGGALVKPGGSLRLSCAASGFTFSKAWMSWVRQAPGKGLEWVGRIKAVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1351) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1545) |
| 20 | AIP-199834 | EVQLVESGGALVKPGGSLRLSCAASGFTFSKAWMSWVRQAPGKGLEWVGRIKSATDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1352) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1546) |
| 21 | AIP-143179 | EVQLVESGGALVKPGGSLRLSCAASGFTFSKAWMSWVRQAPGKGLEWVGRIKSNTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1353) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1547) |
| 21 | AIP-195587 | EVQLVESGGALVKPGGSLRLSCAASGFTFSKAWMSWVRQAPGKGLEWVGRIKSVHDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1354) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1548) |
| 23 | AIP-153462 | EVQLVESGGALVKPGGSLRLSCAASGFTFSKAWMSWVRQAPGKGLEWVGRIKSVDDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1355) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1549) |
| 24 | AIP-115363 | EVQLVESGGALVKPGGSLRLSCAASGFTFSKAWMSWVRQAPGKGLEWVGRIKSVQDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1356) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1550) |
| 25 | AIP-151090 | EVQLVESGGALVKPGGSLRLSCAASGFTFSKAWMSWVRQAPGKGLEWVGRIKSVTNGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1357) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1551) |
| 26 | AIP-168083 | EVQLVESGGALVKPGGSLRLSCAASGFTFSKAWMSWVRQAPGKGLEWVGRIKSVTDAETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1358) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1552) |

TABLE 2A-continued

| | AIP Number | $V_H$ Sequence | $V_L$ Sequence |
|---|---|---|---|
| 27 | AIP-161082 | EVQLVESGGALVKPGGSLRLSCAASGFTFSKAWMSWVRQAPGKGLEWVGRIKSVTDGQTTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1359) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1553) |
| 28 | AIP-114196 | EVQLVESGGALVKPGGSLRLSCAASGFTFSKAWMSWVRQAPGKGLEWVGRIKSVTDGHTTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1360) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1554) |
| 29 | AIP-189338 | EVQLVESGGALVKPGGSLRLSCAASGFTFSKAWMSWVRQAPGKGLEWVGRIKSVTDGEQTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1361) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1555) |
| 30 | AIP-183190 | EVQLVESGGALVKPGGSLRLSCAASGFTFSKAWMSWVRQAPGKGLEWVGRIKSVTDGEATDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1362) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1556) |
| 31 | AIP-110143 | EVQLVESGGALVKPGGSLRLSCAASGFTFSKAWMSWVRQAPGKGLEWVGRIKSVTDGETTDYASPVKGRFTISRDDSKSTLYLQMNSLKTEDTAVYYCTSSFCCRGGSCPSHDTSYCGGQYKSYYYMDVWGKGTTVTVSS (SEQ ID NO: 1363) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1557) |
| 32 | AIP-147176 | EVQLVESGGALVKPGGSLRLSCAASGFTFSKAWMSWVRQAPGKGLEWVGRIKSVTDGETTDYAAPVQGRFTISRDDSKSTLYLQMNSLKTEDTAVYYCTSSFCCRGGSCPSHDTSYCGGQYKSYYYMDVWGKGTTVTVSS (SEQ ID NO: 1364) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1558) |
| 33 | AIP-134312 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCRGGSCPSHDTSYCGGQYKSYYYMDVWGKGTTVTVSS (SEQ ID NO: 1365) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1559) |
| 34 | AIP-128243 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFCCRGGSCPSHDTSYCGGQYKSYYYMDVWGKGTTVTVSS (SEQ ID NO: 1366) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1560) |
| 35 | AIP-156172 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSPFCCRGGSCPSHDTSYCGGQYKSYYYMDVWGKGTTVTVSS (SEQ ID NO: 1367) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1561) |

TABLE 2A-continued

| | AIP Number | $V_H$ Sequence | $V_L$ Sequence |
|---|---|---|---|
| 36 | AIP-147389 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSAFCCRGGSCPSHDTSYCGGQYKSYYYMDVWGKGTTVTVSS (SEQ ID NO: 1368) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1562) |
| 37 | AIP-124314 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSYCCRGGSCPSHDTSYCGGQYKSYYYMDVWGKGTTVTVSS (SEQ ID NO: 1369) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1563) |
| 38 | AIP-185291 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCLGGSCPSHDTSYCGGQYKSYYYMDVWGKGTTVTVSS (SEQ ID NO: 1370) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1564) |
| 39 | AIP-135247 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCHGGSCPSHDTSYCGGQYKSYYYMDVWGKGTTVTVSS (SEQ ID NO: 1371) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1565) |
| 40 | AIP-113513 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCQGGSCPSHDTSYCGGQYKSYYYMDVWGKGTTVTVSS (SEQ ID NO: 1372) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1566) |
| 41 | AIP-102299 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRSGSCPSHDTSYCGGQYKSYYYMDVWGKGTTVTVSS (SEQ ID NO: 1373) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1567) |
| 42 | AIP-179097 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGASCPSHDTSYCGGQYKSYYYMDVWGKGTTVTVSS (SEQ ID NO: 1374) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1568) |
| 4 | 3AIP-109343 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGKSCPSHDTSYCGGQYKSYYYMDVWGKGTTVTVSS (SEQ ID NO: 1375) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1569) |
| 44 | AIP-119622 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGNSCPSHDTSYCGGQYKSYYYMDVWGKGTTVTVSS (SEQ ID NO: 1376) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1570) |

TABLE 2A-continued

| | AIP Number | $V_H$ Sequence | $V_L$ Sequence |
|---|---|---|---|
| 45 | AIP-191735 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGNCPSHDTSYCGGQYKSYYYMDVWGKGTTVTVSS (SEQ ID NO: 1377) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1571) |
| 46 | AIP-157078 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGQCPSHDTSYCGGQYKSYYYMDVWGKGTTVTVSS (SEQ ID NO: 1378) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1572) |
| 47 | AIP-153475 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGACPSHDTSYCGGQYKSYYYMDVWGKGTTVTVSS (SEQ ID NO: 1379) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1573) |
| 48 | AIP-133650 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCASHDTSYCGGQYKSYYYMDVWGKGTTVTVSS (SEQ ID NO: 1380) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1574) |
| 49 | AIP-190915 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCLSHDTSYCGGQYKSYYYMDVWGKGTTVTVSS (SEQ ID NO: 1381) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1575) |
| 50 | AIP-105241 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPAHDTSYCGGQYKSYYYMDVWGKGTTVTVSS (SEQ ID NO: 1382) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1576) |
| 51 | AIP-167400 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPNHDTSYCGGQYKSYYYMDVWGKGTTVTVSS (SEQ ID NO: 1383) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1577) |
| 52 | AIP-109729 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSSDTSYCGGQYKSYYYMDVWGKGTTVTVSS (SEQ ID NO: 1384) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1578) |
| 53 | AIP-151709 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSQDTSYCGGQYKSYYYMDVWGKGTTVTVSS (SEQ ID NO: 1385) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1579) |

TABLE 2A-continued

| | AIP Number | $V_H$ Sequence | $V_L$ Sequence |
|---|---|---|---|
| 54 | AIP-<br>137169 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHETSYCGGQ<br>YKSYYYMDVWGKGTTVTVSS<br>(SEQ ID NO: 1386) | QSVLTQPPSASGTPGQRVTISCSGSSS<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1580) |
| 55 | AIP-<br>199616 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDQSYCGGQ<br>YKSYYYMDVWGKGTTVTVSS<br>(SEQ ID NO: 1387) | QSVLTQPPSASGTPGQRVTISCSGSSS<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1581) |
| 56 | AIP-<br>189296 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSMCGGQ<br>YKSYYYMDVWGKGTTVTVSS<br>(SEQ ID NO: 1388) | QSVLTQPPSASGTPGQRVTISCSGSSS<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1582) |
| 57 | AIP-<br>152283 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCAGQ<br>YKSYYYMDVWGKGTTVTVSS<br>(SEQ ID NO: 1389) | QSVLTQPPSASGTPGQRVTISCSGSSS<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1583) |
| 58 | AIP-<br>136628 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCNGQ<br>YKSYYYMDVWGKGTTVTVSS<br>(SEQ ID NO: 1390) | QSVLTQPPSASGTPGQRVTISCSGSSS<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1584) |
| 59 | AIP-<br>100340 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCGNQ<br>YKSYYYMDVWGKGTTVTVSS<br>(SEQ ID NO: 1391) | QSVLTQPPSASGTPGQRVTISCSGSSS<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1585) |
| 60 | AIP-<br>166959 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCGAQ<br>YKSYYYMDVWGKGTTVTVSS<br>(SEQ ID NO: 1392) | QSVLTQPPSASGTPGQRVTISCSGSSS<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1586) |
| 61 | AIP-<br>190362 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCGGS<br>YKSYYYMDVWGKGTTVTVSS<br>(SEQ ID NO: 1393) | QSVLTQPPSASGTPGQRVTISCSGSSS<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1587) |
| 62 | AIP-<br>101601 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCGGY<br>YKSYYYMDVWGKGTTVTVSS<br>(SEQ ID NO: 1394) | QSVLTQPPSASGTPGQRVTISCSGSSS<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1588) |

TABLE 2A-continued

| | AIP Number | $V_H$ Sequence | $V_L$ Sequence |
|---|---|---|---|
| 63 | AIP-159023 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQFKSYYYMDVWGKGTTVTVSS (SEQ ID NO: 1395) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1589) |
| 64 | AIP-146871 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYPSYYYMDVWGKGTTVTVSS (SEQ ID NO: 1396) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1590) |
| 65 | AIP-170053 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYASYYYMDVWGKGTTVTVSS (SEQ ID NO: 1397) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1591) |
| 66 | AIP-199483 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYQSYYYMDVWGKGTTVTVSS (SEQ ID NO: 1398) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1592) |
| 67 | AIP-161048 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKDYYYMDVWGKGTTVTVSS (SEQ ID NO: 1399) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1593) |
| 68 | AIP-162041 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSFYYMDVWGKGTTVTVSS (SEQ ID NO: 1400) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1594) |
| 69 | AIP-197886 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYFYMDVWGKGTTVTVSS (SEQ ID NO: 1401) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1595) |
| 70 | AIP-183133 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYWMDVWGKGTTVTVSS (SEQ ID NO: 1402) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1596) |
| 71 | AIP-191470 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYLMDVWGKGTTVTVSS (SEQ ID NO: 1403) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1597) |

TABLE 2A-continued

| | AIP Number | $V_H$ Sequence | $V_L$ Sequence |
|---|---|---|---|
| 72 | AIP-151167 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYVDVWGKGTTVTVSS (SEQ ID NO: 1404) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1598) |
| 73 | AIP-106633 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYFDVWGKGTTVTVSS (SEQ ID NO: 1405) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1599) |
| 74 | AIP-102624 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMNVWGKGTTVTVSS (SEQ ID NO: 1406) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1600) |
| 75 | AIP-109484 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDIWGKGTTVTVSS (SEQ ID NO: 1407) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1601) |
| 76 | AIP-164754 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDPWGKGTTVTVSS (SEQ ID NO: 1408) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1602) |
| 77 | AIP-169676 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQFKDYYYMDVWGKGTTVTVSS (SEQ ID NO: 1409) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1603) |
| 78 | AIP-177584 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQSKQYYYMDVWGKGTTVIVSS (SEQ ID NO: 1410) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1604) |
| 79 | AIP-174676 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQSKKYYYMDVWGKGTTVTVSS (SEQ ID NO: 1411) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1605) |
| 80 | AIP-120546 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFSCRGGSCPSHDTSYSGGQYKSYYYMDVWGKGTTVTVSS (SEQ ID NO: 1412) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1606) |

TABLE 2A-continued

| | AIP Number | $V_H$ Sequence | $V_L$ Sequence |
|---|---|---|---|
| 81 | AIP-186435 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFACRGGSCPSHDTSYVGGQYKSYYYMDVWGKGTTVTVSS (SEQ ID NO: 1413) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1607) |
| 82 | AIP-171074 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGNSCPAHDTSYCGGQYPSYYYMDVWGKGTTVTVSS (SEQ ID NO: 1414) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1608) |
| 83 | AIP-163039 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSYCCLGGSCPSHDTSYCGGSYKSYYYMDVWGKGTTVTVSS (SEQ ID NO: 1415) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1609) |
| 84 | AIP-147652 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGKSCPSHDNSYCGGQYASYYYMDVWGKGTTVTVSS (SEQ ID NO: 1416) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1610) |
| 85 | AIP-182061 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSYCCRGGSCPSHDTSYCGGQFKSYYYMDPWGKGTTVTVSS (SEQ ID NO: 1417) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1611) |
| 86 | AIP-172643 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSTFCCRGGSCLSHDTSYCGGQYKSYYWMDVWGKGTTVIVSS (SEQ ID NO: 1418) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1612) |
| 87 | AIP-171912 | EVQLVESGGALVKPGGSLRLSCAASGFDFSKAWMSWVRQAPGKGLEWVGRIKSVTDGQTTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1419) | QSVLTQPPSASGTPGQRVTISCTGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1613) |
| 88 | AIP-167833 | EVQLVESGGALVKPGGSLRLSCAASGFTFAKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1420) | QSVLTQPPSASGTPGQRVTISCSGSSTNIGSSSVSWYQQLPGTAPKLLIYKNNYRPSGVPDRFSGSKSGTSASLAISGLRSEDEADYYCSTWDDSLSVRVFGGGTKLTVL (SEQ ID NO: 1614) |
| 89 | AIP-145518 | EVQLVESGGALVKPGGSLRLSCAASGFDASKAWFTWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1421) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1615) |

TABLE 2A-continued

| | AIP Number | $V_H$ Sequence | $V_L$ Sequence |
|---|---|---|---|
| 90 | AIP-<br>143155 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCGGQ<br>YKSYYYMDVWGKGTTVTVSS<br>(SEQ ID NO: 1422) | QSVLTQPPSASGTPGQRVTISCTGSSS<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1616) |
| 91 | AIP-<br>119664 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCGGQ<br>YKSYYYMDVWGKGTTVTVSS<br>(SEQ ID NO: 1423) | QSVLTQPPSASGTPGQRVTISCSGASS<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1617) |
| 92 | AIP-<br>190526 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCGGQ<br>YKSYYYMDVWGKGTTVTVSS<br>(SEQ ID NO: 1424) | QSVLTQPPSASGTPGQRVTISCSGSPS<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1618) |
| 93 | AIP-<br>114403 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCGGQ<br>YKSYYYMDVWGKGTTVTVSS<br>(SEQ ID NO: 1425) | QSVLTQPPSASGTPGQRVTISCSGSKS<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1619) |
| 94 | AIP-<br>156760 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCGGQ<br>YKSYYYMDVWGKGTTVTVSS<br>(SEQ ID NO: 1426) | QSVLTQPPSASGTPGQRVTISCSGSST<br>NIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1620) |
| 95 | AIP-<br>103803 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCGGQ<br>YKSYYYMDVWGKGTTVTVSS<br>(SEQ ID NO: 1427) | QSVLTQPPSASGTPGQRVTISCSGSSS<br>DIGSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1621) |
| 96 | AIP-<br>182722 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCGGQ<br>YKSYYYMDVWGKGTTVTVSS<br>(SEQ ID NO: 1428) | QSVLTQPPSASGTPGQRVTISCSGSSS<br>NIQSSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1622) |
| 97 | AIP-<br>195588 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCGGQ<br>YKSYYYMDVWGKGTTVTVSS<br>(SEQ ID NO: 1429) | QSVLTQPPSASGTPGQRVTISCSGSSS<br>NIGHSSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1623) |
| 98 | AIP-<br>145722 | EVQLVESGGALVKPGGSLRLSCAA<br>SGFTFSKAWMSWVRQAPGKGLEWV<br>GRIKSVTDGETTDYAAPVKGRFTI<br>SRDDSKSTLYLQMNSLKTEDTAVY<br>YCTSSFCCRGGSCPSHDTSYCGGQ<br>YKSYYYMDVWGKGTTVTVSS<br>(SEQ ID NO: 1430) | QSVLTQPPSASGTPGQRVTISCSGSSS<br>NIGSTSVSWYQQLPGTAPKLLIYKNNQ<br>RPSGVPDRFSGSKSGTSASLAISGLRS<br>EDEADYYCSTWDDSLSVRVFGGGTKLT<br>VL (SEQ ID NO: 1624) |

TABLE 2A-continued

| | AIP Number | $V_H$ Sequence | $V_L$ Sequence |
|---|---|---|---|
| 99 | AIP-178251 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1431) | QSVLTQPPSASGTPGQRVTISCSGSSSNIGSNSVSWYQQLPGTAPKLLIYKNNQRPSGVPDRFSGSKSGTSASLAISGLRSEDEADYYCSTWDDSLSVRVFGGGTKLTVL (SEQ ID NO: 1625) |
| 100 | AIP-116142 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1432) | QSVLTQPPSASGTPGQRVTISCSGSSSNIGSASVSWYQQLPGTAPKLLIYKNNQRPSGVPDRFSGSKSGTSASLAISGLRSEDEADYYCSTWDDSLSVRVFGGGTKLTVL (SEQ ID NO: 1626) |
| 101 | AIP-183350 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1433) | QSVLTQPPSASGTPGQRVTISCSGSSSNIGSSTVSWYQQLPGTAPKLLIYKNNQRPSGVPDRFSGSKSGTSASLAISGLRSEDEADYYCSTWDDSLSVRVFGGGTKLTVL (SEQ ID NO: 1627) |
| 102 | AIP-127108 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1433) | QSVLTQPPSASGTPGQRVTISCSGSSSNIGSSAVSWYQQLPGTAPKLLIYKNNQRPSGVPDRFSGSKSGTSASLAISGLRSEDEADYYCSTWDDSLSVRVFGGGTKLTVL (SEQ ID NO: 1628) |
| 103 | AIP-128147 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1435) | QSVLTQPPSASGTPGQRVTISCSGSSSNIGSSYVSWYQQLPGTAPKLLIYKNNQRPSGVPDRFSGSKSGTSASLAISGLRSEDEADYYCSTWDDSLSVRVFGGGTKLTVL (SEQ ID NO: 1629) |
| 104 | AIP-109510 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1436) | QSVLTQPPSASGTPGQRVTISCSGSSSNIGSSSTSWYQQLPGTAPKLLIYKNNQRPSGVPDRFSGSKSGTSASLAISGLRSEDEADYYCSTWDDSLSVRVFGGGTKLTVL (SEQ ID NO: 1630) |
| 105 | AIP-104086 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1437) | QSVLTQPPSASGTPGQRVTISCSGSSSNIGSSSVAWYQQLPGTAPKLLIYKNNQRPSGVPDRFSGSKSGTSASLAISGLRSEDEADYYCSTWDDSLSVRVFGGGTKLTVL (SEQ ID NO: 1631) |
| 106 | AIP-143132 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1438) | QSVLTQPPSASGTPGQRVTISCSGSSSNIGSSSVTWYQQLPGTAPKLLIYKNNQRPSGVPDRFSGSKSGTSASLAISGLRSEDEADYYCSTWDDSLSVRVFGGGTKLTVL (SEQ ID NO: 1632) |
| 107 | AIP-169636 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1439) | QSVLTQPPSASGTPGQRVTISCSGSSSNIGSSSVSWYQQLPGTAPKLLIYRNNQRPSGVPDRFSGSKSGTSASLAISGLRSEDEADYYCSTWDDSLSVRVFGGGTKLTVL (SEQ ID NO: 1633) |

TABLE 2A-continued

| | AIP Number | $V_H$ Sequence | $V_L$ Sequence |
|---|---|---|---|
| 108 | AIP-152243 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1440) | QSVLTQPPSASGTPGQRVTISCSGSSSNIGSSSVSWYQQLPGTAPKLLIYNNNQRPSGVPDRFSGSKSGTSASLAISGLRSEDEADYYCSTWDDSLSVRVFGGGTKLTVL (SEQ ID NO: 1634) |
| 109 | AIP-138776 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1441) | QSVLTQPPSASGTPGQRVTISCSGSSSNIGSSSVSWYQQLPGTAPKLLIYMNNQRPSGVPDRFSGSKSGTSASLAISGLRSEDEADYYCSTWDDSLSVRVFGGGTKLTVL (SEQ ID NO: 1635) |
| 110 | AIP-103817 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1442) | QSVLTQPPSASGTPGQRVTISCSGSSSNIGSSSVSWYQQLPGTAPKLLIYANNQRPSGVPDRFSGSKSGTSASLAISGLRSEDEADYYCSTWDDSLSVRVFGGGTKLTVL (SEQ ID NO: 1636) |
| 111 | AIP-130491 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1443) | QSVLTQPPSASGTPGQRVTISCSGSSSNIGSSSVSWYQQLPGTAPKLLIYHNNQRPSGVPDRFSGSKSGTSASLAISGLRSEDEADYYCSTWDDSLSVRVFGGGTKLTVL (SEQ ID NO: 1637) |
| 112 | AIP-188155 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1444) | QSVLTQPPSASGTPGQRVTISCSGSSSNIGSSSVSWYQQLPGTAPKLLIYKDNQRPSGVPDRFSGSKSGTSASLAISGLRSEDEADYYCSTWDDSLSVRVFGGGTKLTVL (SEQ ID NO: 1638) |
| 113 | AIP-167246 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1445) | QSVLTQPPSASGTPGQRVTISCSGSSSNIGSSSVSWYQQLPGTAPKLLIYKNTQRPSGVPDRFSGSKSGTSASLAISGLRSEDEADYYCSTWDDSLSVRVFGGGTKLTVL (SEQ ID NO: 1639) |
| 114 | AIP-106139 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1446) | QSVLTQPPSASGTPGQRVTISCSGSSSNIGSSSVSWYQQLPGTAPKLLIYKNNYRPSGVPDRFSGSKSGTSASLAISGLRSEDEADYYCSTWDDSLSVRVFGGGTKLTVL (SEQ ID NO: 1640) |
| 115 | AIP-198351 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1447) | QSVLTQPPSASGTPGQRVTISCSGSSSNIGSSSVSWYQQLPGTAPKLLIYKNNARPSGVPDRFSGSKSGTSASLAISGLRSEDEADYYCSTWDDSLSVRVFGGGTKLTVL (SEQ ID NO: 1641) |
| 116 | AIP-159326 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1448) | QSVLTQPPSASGTPGQRVTISCSGSSSNIGSSSVSWYQQLPGTAPKLLIYKNNLRPSGVPDRFSGSKSGTSASLAISGLRSEDEADYYCSTWDDSLSVRVFGGGTKLTVL (SEQ ID NO: 1642) |

TABLE 2A-continued

| | AIP Number | $V_H$ Sequence | $V_L$ Sequence |
|---|---|---|---|
| 117 | AIP-192275 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1449) | QSVLTQPPSASGTPGQRVTISCSGSSSNIGSSSVSWYQQLPGTAPKLLIYKNNQQPSGVPDRFSGSKSGTSASLAISGLRSEDEADYYCSTWDDSLSVRVFGGGTKLTVL (SEQ ID NO: 1643) |
| 118 | AIP-190761 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1450) | QSVLTQPPSASGTPGQRVTISCSGSSSNIGSSSVSWYQQLPGTAPKLLIYKNNQRASGVPDRFSGSKSGTSASLAISGLRSEDEADYYCSTWDDSLSVRVFGGGTKLTVL (SEQ ID NO: 1644) |
| 119 | AIP-166832 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1451) | QSVLTQPPSASGTPGQRVTISCSGSSSNIGSSSVSWYQQLPGTAPKLLIYKNNQRPYGVPDRFSGSKSGTSASLAISGLRSEDEADYYCSTWDDSLSVRVFGGGTKLTVL (SEQ ID NO: 1645) |
| 120 | AIP-148062 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1452) | QSVLTQPPSASGTPGQRVTISCSGSSSNIGSSSVSWYQQLPGTAPKLLIYKNNQRPLGVPDRFSGSKSGTSASLAISGLRSEDEADYYCSTWDDSLSVRVFGGGTKLTVL (SEQ ID NO: 1646) |
| 121 | AIP-129145 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1453) | QSVLTQPPSASGTPGQRVTISCSGSSSNIGSSSVSWYQQLPGTAPKLLIYKNNQRPSGVPDRFSGSKSGTSASLAISGLRSEDEADYYCATWDDSLSVRVFGGGTKLTVL (SEQ ID NO: 1647) |
| 122 | AIP-111240 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1454) | QSVLTQPPSASGTPGQRVTISCSGSSSNIGSSSVSWYQQLPGTAPKLLIYKNNQRPSGVPDRFSGSKSGTSASLAISGLRSEDEADYYCSSWDDSLSVRVFGGGTKLTVL (SEQ ID NO: 1648) |
| 123 | AIP-190749 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1455) | QSVLTQPPSASGTPGQRVTISCSGSSSNIGSSSVSWYQQLPGTAPKLLIYKNNQRPSGVPDRFSGSKSGTSASLAISGLRSEDEADYYCSTFDDSLSVRVFGGGTKLTVL (SEQ ID NO: 1649) |
| 124 | AIP-153888 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1456) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDNSLSVRVFGGGTKLTVL (SEQ ID NO: 1650) |
| 125 | AIP-130915 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1457) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDQLSVRVFGGGTKLTVL (SEQ ID NO: 1651) |

TABLE 2A-continued

| | AIP Number | $V_H$ Sequence | $V_L$ Sequence |
|---|---|---|---|
| 126 | AIP-109048 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1458) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDALSVRVFGGGTKLTVL (SEQ ID NO: 1652) |
| 127 | AIP-170569 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1459) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDDLSVRVFGGGTKLTVL (SEQ ID NO: 1653) |
| 128 | AIP-154873 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1460) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSNSVRVFGGGTKLTVL (SEQ ID NO: 1654) |
| 129 | AIP-159037 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1461) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSSSVRVFGGGTKLTVL (SEQ ID NO: 1655) |
| 130 | AIP-186826 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1462) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLNVRVFGGGTKLTVL (SEQ ID NO: 1656) |
| 131 | AIP-156514 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1463) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLLVRVFGGGTKLTVL (SEQ ID NO: 1657) |
| 132 | AIP-157122 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1464) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLTVRVFGGGTKLTVL (SEQ ID NO: 1658) |
| 133 | AIP-173276 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1465) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSIRVFGGGTKLTVL (SEQ ID NO: 1659) |
| 134 | AIP-150485 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1466) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVKVFGGGTKLTVL (SEQ ID NO: 1660) |

TABLE 2A-continued

| | AIP Number | $V_H$ Sequence | $V_L$ Sequence |
|---|---|---|---|
| 135 | AIP-135679 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1467) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVWVFGGGTKLTVL (SEQ ID NO: 1661) |
| 136 | AIP-166847 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1468) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVHVFGGGTKLTVL (SEQ ID NO: 1662) |
| 137 | AIP-124013 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1469) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVQVFGGGTKLTVL (SEQ ID NO: 1663) |
| 138 | AIP-126285 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1470) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRIFGGGTKLTVL (SEQ ID NO: 1664) |
| 139 | AIP-190274 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1471) | QSVLTQPPSASGTPGQRVTISCSGSSSDIGSSSVSWYQQLPGTAPKLLIYKNNQRPSGVPDRFSGSKSGTSASLAISGLRSEDEADYYCSTWNDQLSVRVFGGGTKLTVL (SEQ ID NO: 1665) |
| 140 | AIP-150277 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1472) | QSVLTQPPSASGTPGQRVTISCHGSESDIGSHDVLWYQQLPGTAPKLLIYKNNQRPSGVPDRFSGSKSGTSASLAISGLRSEDEADYYCSTWDDSLSVRVFGGGTKLTVL (SEQ ID NO: 1666) |
| 141 | AIP-104364 | EVQLVESGGALVKPGGSLRLSCAASGFTFSKAWYSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1473) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1667) |
| 142 | AIP-180422 | EVQLVESGGGLVQPGGSLRLSCAASGFTFSKAWMSWVRQAPGKGLEWVGRIKSVTDGETTEYAASVKGRFTISRDDSKNSLYLQMNSLKTEDTAVYYCTSSFCCRGGSCPSHDTSYCGGQYKSYYYMDVWGKGTTVTVSS (SEQ ID NO: 1474) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1668) |
| 143 | AIP-166722 | EVQLVESGGGLVQPGGSLRLSCAASGFTFSKAWMSWVRQAPGKGLEWVGRIKSVTDGETTEYAASVKGRFTISRDDSKNSLYLQMNSLKTEDTAVYYCTSSFCCRGGSCPSHDTSYCGGQYKSYYYMDVWGKGTTVTVSS (SEQ ID NO: 1475) | QSVLTQPPSVSGAPGQRVTISCSGSSSNIGSSSVSWYQQLPGTAPKLLIYKNNQRPSGVPDRFSGSKSGTSASLAITGLQAEDEADYYCSTWDDSLSVRVFGGGTKLTVL (SEQ ID NO: 1669) |

TABLE 2A-continued

| | AIP Number | $V_H$ Sequence | $V_L$ Sequence |
|---|---|---|---|
| 144 | AIP-193490 | EVQLVESGGGLVQPGPSLRLSCTA SGFTFSKAWMSWVRQAPGKGLEWV GFIKSVTDGETTEYAASVKGRFTI SRDDSKSIAYLQMNSLKTEDTAVY YCTSSFCCRGGSCPSHDTSYCGGQ YKSYYYMDVWGKGTTVTVSS (SEQ ID NO: 1476) | QSVLTQPPSVSGAPGQRVTISCSGSSS NIGSSSVSWYQQLPGTAPKLLIYKNNQ RPSGVPDRFSGSKSGTSASLAITGLQA EDEADYYCSTWDDSLSVRVFGGGTKLT VL (SEQ ID NO: 1670) |
| 145 | AIP-129967 | EVQLVESGGALVKPGGSLRLSCAA SGFTFSKAWMSWVRQAPGKGLEWV GRIKSVTDGETTDYAAPVKGRFTI SRDDSKSTLYLQMNSLKTEDTAVY YCTSSYCCRSGSCPSSDTSYCNGQ FKSYYYMDPWGKGTTVTVSS (SEQ ID NO: 1477) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1671) |
| 146 | AIP-126175 | EVQLVESGGALVKPGGSLRLSCAA SGFTFSKAWMSWVRQAPGKGLEWV GRIKSVTDGETTDYAAPVKGRFTI SRDDSKSTLYLQMNSLKTEDTAVY YCTSSFCCRSGSCPSSDTSYCNGQ YKSYYYVNIWGKGTTVTVSS (SEQ ID NO: 1478) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1672) |
| 147 | AIP-180905 | EVQLVESGGALVKPGGSLRLSCAA SGFTFSKAWMSWVRQAPGKGLEWV GRIKSVTDGETTDYAAPVKGRFTI SRDDSKSTLYLQMNSLKTEDTAVY YCTTSFCCRGASCPSHDTSYCAGS YKSYYYVNIWGKGTTVTVSS (SEQ ID NO: 1479) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1673) |
| 148 | AIP-141706 | EVQLVESGGALVKPGGSLRLSCAA SGFTFSKAWMSWVRQAPGKGLEWV GRIKSVTDGETTDYAAPVKGRFTI SRDDSKSTLYLQMNSLKTEDTAVY YCTSAFCCRGKSCPSSDTSYCGGQ YPSYYYVNIWGKGTTVTVSS (SEQ ID NO: 1480) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1674) |
| 149 | AIP-105092 | EVQLVESGGALVKPGGSLRLSCAA SGFTFSKAWMSWVRQAPGKGLEWV GRIKSVTDGETTDYAAPVKGRFTI SRDDSKSTLYLQMNSLKTEDTAVY YCTSAFCCRGKSCPSHDTSFCGGQ DKRYYYVNIWGKGTTVTVSS (SEQ ID NO: 1481) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1675) |
| 150 | AIP-152031 | EVQLVESGGALVKPGGSLRLSCAA SGFTFSKAWMSWVRQAPGKGLEWV GRIKSVTDGETTDYAAPVKGRFTI SRDDSKSTLYLQMNSLKTEDTAVY YCTSAFCCRGGNCPSHETSYCNGQ NKQYYYMDVWGKGTTVTVSS (SEQ ID NO: 1482) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1676) |
| 151 | AIP-163319 | EVQLVESGGALVKPGGSLRLSCAA SGFTFSKAWMSWVRQAPGKGLEWV GRIKSVTDGETTDYAAPVKGRFTI SRDDSKSTLYLQMNSLKTEDTAVY YCTSSFCCRGNQCPSSDTSFCGGQ DKRYYYMDPWGKGTTVTVSS (SEQ ID NO: 1483) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1677) |
| 152 | AIP-160621 | EVQLVESGGALVKPGGSLRLSCAA SGFTFSKAWMSWVRQAPGKGLEWV GRIKSVTDGETTDYAAPVKGRFTI SRDDSKSTLYLQMNSLKTEDTAVY YCTTSFCCRGNQCPSHETSYCGGY YKSYFYMDVWGKGTTVTVSS (SEQ ID NO: 1484) | QSVLTQPPSASGTPGQRVTISCSGSSS NIGSSSVSWYQQLPGTAPKLLIYKNNQ RPSGVPDRFSGSKSGTSASLAISGLRS EDEADYYCSTWDDSLSVRVFGGGTKLT VL (SEQ ID NO: 1678) |

TABLE 2A-continued

| | AIP Number | $V_H$ Sequence | $V_L$ Sequence |
|---|---|---|---|
| 153 | AIP-145212 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSYCCRGKQCPSHDTSYCAGQYADYYYMDVWGKGTTVTVSS (SEQ ID NO: 1485) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1679) |
| 154 | AIP-112328 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCRGKQCPSSDTSYCNGQYADYYYMDVWGKGTTVTVSS (SEQ ID NO: 1486) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1680) |
| 155 | AIP-193106 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGKQCPSSDTSYCNGQYADYYYVNIWGKGTTVTVSS (SEQ ID NO: 1487) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1681) |
| 156 | AIP-125062 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCRGKQCPSSDTSFCGGQDKRYYFMDVWGKGTTVTVSS (SEQ ID NO: 1488) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1682) |
| 157 | AIP-124301 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSAFCCRGKQCPSSDTSYCGGQYASFYYMDVWGKGTTVTVSS (SEQ ID NO: 1489) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1683) |
| 158 | AIP-124068 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCQGNNCPSSDTSYCGGYYKDYYYMDVWGKGTTVTVSS (SEQ ID NO: 1490) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1684) |
| 159 | AIP-144568 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCQGNNCPSHDTSYCGGQYKSYYYVNIWGKGTTVTVSS (SEQ ID NO: 1491) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1685) |
| 160 | AIP-139782 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCQGKNCPSHETSYCGGQYADYYYMDVWGKGTTVTVSS (SEQ ID NO: 1492) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1686) |
| 161 | AIP-171543 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFCCHGNSCPSSDTSYCGGQNKQYYYMDVWGKGTTVTVSS (SEQ ID NO: 1493) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1687) |

TABLE 2A-continued

| | AIP Number | $V_H$ Sequence | $V_L$ Sequence |
|---|---|---|---|
| 162 | AIP-140148 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCHGNSCPSHDTSYCNGQNKQYYYMDVWGKGTTVTVSS (SEQ ID NO: 1494) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1688) |
| 163 | AIP-177193 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCHSNNCPSSDTSYCNGQYKQYYYMDVWGKGTTVTVSS (SEQ ID NO: 1495) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1689) |
| 164 | AIP-171348 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCHSNNCPSHDTSYCGGQYKSYYYVNIWGKGTTVTVSS (SEQ ID NO: 1496) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1690) |
| 165 | AIP-193088 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFACHSNNCPSSDTSYVNGYYKQYYFMDVWGKGTTVTVSS (SEQ ID NO: 1497) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1691) |
| 166 | AIP-182087 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCHSNNCPSSDTSYCNGQYKQYYYVNIWGKGTTVTVSS (SEQ ID NO: 1498) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1692) |
| 167 | AIP-151388 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCLGKACLSHDTSYCGGQYASYYYVNIWGKGTTVTVSS (SEQ ID NO: 1499) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1693) |
| 168 | AIP-149787 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCLGKACLSSDTSYCGGYYASYYFVNIWGKGTTVTVSS (SEQ ID NO: 1500) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1694) |
| 169 | AIP-126097 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFACLGKACLSSDTSYVGGYYASYYFVNIWGKGTTVTVSS (SEQ ID NO: 1501) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1695) |
| 170 | AIP-107759 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSYCCLGNSCPSSDTSYCGGQFKSYYYMDPWGKGTTVTVSS (SEQ ID NO: 1502) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1696) |

TABLE 2A-continued

| | AIP Number | $V_H$ Sequence | $V_L$ Sequence |
|---|---|---|---|
| 171 | AIP-148484 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSYCCLGNSCPSSDTSFCGGQDKRYYYMDPWGKGTTVTVSS (SEQ ID NO: 1503) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1697) |
| 172 | AIP-186403 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCLGGNCPSSETSYCGNQYPSYYYMDVWGKGTTVTVSS (SEQ ID NO: 1504) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1698) |
| 173 | AIP-166629 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCLGGNCPSSETSYCGNYYPSYFYMDVWGKGTTVTVSS (SEQ ID NO: 1505) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1699) |
| 174 | AIP-165276 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCLGGNCPSSETSYCGNQYPSYYYVNIWGKGTTVTVSS (SEQ ID NO: 1506) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1700) |
| 175 | AIP-188293 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFACRGNQCPSHETSYVGGYYKSYFYMDVWGKGTTVTVSS (SEQ ID NO: 1507) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1701) |
| 176 | AIP-109364 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFACRGNQCPSSETSYVGGYYKSYFFMDVWGKGTTVIVSS (SEQ ID NO: 1508) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1702) |
| 177 | AIP-191805 | EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFACRGKQCPSSDTSYVGGQFKSYYFMDVWGKGTTVTVSS (SEQ ID NO: 1509) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1703) |
| 178 | AIP-181592 | EVQLVESGGALVKPGGSLRLSCAASGFTFAKAWMSWVRQAPGKGLEWVGRIKAADDGKQTDYAAPVKGRFTISRDDSKSTLYLQMNSLKTEDTAVYYCTSSFCCRGGSCLSHDTSYCGGQYKSYYWMDVWGKGTTVIVSS (SEQ ID NO: 1510) | QSVLTQPPSASGTPGQRVTISCSGSSTNIGSSSVYWYQQLPGTAPKLLIYKNNYRPSGVPDRFSGSKSGTSASLAISGLRSEDEADYYCSTWDDSLSVRVFGGGTKLTVL (SEQ ID NO: 1704) |
| 179 | AIP-155587 | EVQLVESGGALVKPGGSLRLSCAASGFTYAKAWMSWVRQAPGKGLEWVGRIKSVQDGEQTDYAAPVKGRFTISRDDSKSTLYLQMNSLKTEDTAVYYCTSSYCCLGGSCPSHDTSYCGGSYKSYYYMDVWGKGTTVTVSS (SEQ ID NO: 1511) | QSVLTQPPSASGTPGQRVTISCSGSSTNIGSSSVYWYQQLPGTAPKLLIYKNNYRASGVPDRFSGSKSGTSASLAISGLRSEDEADYYCSTWDDSLSVRVFGGGTKLTVL (SEQ ID NO: 1705) |

TABLE 2A-continued

| | AIP Number | $V_H$ Sequence | $V_L$ Sequence |
|---|---|---|---|
| 180 | AIP-147945 | EVQLVESGGALVKPGGSLRLSCAASGFDASKAWFTWVRQAPGKGLEWVGRIKSVTDGETTDYAAPVKGRFTISRDDSKSTLYLQMNSLKTEDTAVYYCTSSFCCRGGSCPSHDTSYCGGQNKQYYYMDVWGKGTTVIVSS (SEQ ID NO: 1512) | QSVLTQPPSASGTPGQRVTISCTGSSSNIGSSYVSWYQQLPGTAPKLLIYKNSLRPQGVPDRFSGSKSGTSASLAISGLRSEDEADYYCSTWDDSLSVRVFGGGTKLTVL (SEQ ID NO: 1706) |
| 181 | AIP-199264 | EVQLVESGGALVKPGGSLRLSCAASGFDASKAWFTWVRQAPGKGLEWVGRIKSVTDGETTDYAAPVKGRFTISRDDSKSTLYLQMNSLKTEDTAVYYCTSSFACRGGSCPSHDTSYVGGQYKSYYYMDVWGKGTTVTVSS (SEQ ID NO: 1513) | QSVLTQPPSASGTPGQRVTISCTGSSSNIGSSYVSWYQQLPGTAPKLLIYKNSLRPQGVPDRFSGSKSGTSASLAISGLRSEDEADYYCSTWDDSLSVRVFGGGTKLTVL (SEQ ID NO: 1707) |
| 182 | AIP-123438 | EVQLVESGGALVKPGGSLRLSCAASGFDASKAWFTWVRQAPGKGLEWVGRIKSVTDGETTDYAAPVKGRFTISRDDSKSTLYLQMNSLKTEDTAVYYCTSSYCCLGGSCPSHDTSYCGGSYKSYYYMDVWGKGTTVTVSS (SEQ ID NO: 1514) | QSVLTQPPSASGTPGQRVTISCTGSSSNIGSSYVSWYQQLPGTAPKLLIYKNSLRPQGVPDRFSGSKSGTSASLAISGLRSEDEADYYCSTWDDSLSVRVFGGGTKLTVL (SEQ ID NO: 1708) |
| 183 | AIP-151315 | EVQLVESGGALVKPGGSLRLSCAASGFDASKAWFTWVRQAPGKGLEWVGRIKSVTDGETTDYAAPVKGRFTISRDDSKSTLYLQMNSLKTEDTAVYYCTSSFCCRGKSCPSHDTSYCGGQYASYYYMDVWGKGTTVTVSS (SEQ ID NO: 1515) | QSVLTQPPSASGTPGQRVTISCTGSSSNIGSSYVSWYQQLPGTAPKLLIYKNSLRPQGVPDRFSGSKSGTSASLAISGLRSEDEADYYCSTWDDSLSVRVFGGGTKLTVL (SEQ ID NO: 1709) |
| 184 | AIP-197785 | EVQLVESGGALVKPGGSLRLSCAASGFTFSKAWMSWVRQAPGKGLEWVGRIKAADDGKQTDYAAPVKGRFTISRDDSKSTLYLQMNSLKTEDTAVYYCTSSFCCRGGNCPSHETSYCGNQYKSYYYMDVWGKGTTVTVSS (SEQ ID NO: 1516) | QSVLTQPPSASGTPGQRVTISCSGSPSNIGSASTSWYQQLPGTAPKLLIYKNNQRPSGVPDRFSGSKSGTSASLAISGLRSEDEADYYCSTWDDSLSVRVFGGGTKLTVL (SEQ ID NO: 1710) |
| 185 | AIP-115782 | EVQLVESGGALVKPGGSLRLSCAASGFTFSKAWMSWVRQAPGKGLEWVGRIKAADDGKQTDYAAPVKGRFTISRDDSKSTLYLQMNSLKTEDTAVYYCTSSFCCRSGSCPSSDTSYCNGQYKSYYYMDVWGKGTTVTVSS (SEQ ID NO: 1517) | QSVLTQPPSASGTPGQRVTISCSGSPSNIGSASTSWYQQLPGTAPKLLIYKNNQRPSGVPDRFSGSKSGTSASLAISGLRSEDEADYYCSTWDDSLSVRVFGGGTKLTVL (SEQ ID NO: 1711) |
| 186 | AIP-138130 | EVQLVESGGALVKPGGSLRLSCAASGFTFSKAWMSWVRQAPGKGLEWVGRIKAADDGKQTDYAAPVKGRFTISRDDSKSTLYLQMNSLKTEDTAVYYCTSSFCCRGGSCPSHDTSYCGGQYKSYYYVNIWGKGTTVTVSS (SEQ ID NO: 1518) | QSVLTQPPSASGTPGQRVTISCSGSPSNIGSASTSWYQQLPGTAPKLLIYKNNQRPSGVPDRFSGSKSGTSASLAISGLRSEDEADYYCSTWDDSLSVRVFGGGTKLTVL (SEQ ID NO: 1712) |
| 187 | AIP-170221 | EVQLVESGGALVKPGGSLRLSCAASGFTFSKAWMSWVRQAPGKGLEWVGRIKAADDGKQTDYAAPVKGRFTISRDDSKSTLYLQMNSLKTEDTAVYYCTTSFCCRGASCPSHDTSYCAGSYKSYYYMDVWGKGTTVTVSS (SEQ ID NO: 1519) | QSVLTQPPSASGTPGQRVTISCSGSPSNIGSASTSWYQQLPGTAPKLLIYKNNQRPSGVPDRFSGSKSGTSASLAISGLRSEDEADYYCSTWDDSLSVRVFGGGTKLTVL (SEQ ID NO: 1713) |
| 188 | AIP-167482 | EVQLVESGGALVKPGGSLRLSCAASGFTFSKAWMSWVRQAPGKGLEWVGRIKAADDGKQTDYAAPVKGRFTISRDDSKSTLYLQMNSLKTEDTAVYYCISSFCCRGNSCPSSDTSYCNGQYKSYYYMDVWGKGTTVTVSS (SEQ ID NO: 1520) | QSVLTQPPSASGTPGQRVTISCSGSPSNIGSASTSWYQQLPGTAPKLLIYKNNQRPSGVPDRFSGSKSGTSASLAISGLRSEDEADYYCSTWDDSLSVRVFGGGTKLTVL (SEQ ID NO: 1714) |

TABLE 2A-continued

| | AIP Number | $V_H$ Sequence | $V_L$ Sequence |
|---|---|---|---|
| 189 | AIP-189475 | EVQLVESGGALVKPGGSLRLSCAASGFTFSKAWMSWVRQAPGKGLEWVGRIKAVTDGHTTDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1521) | QSVLTQPPSASGTPGQRVTISCSGASSNIGHSSVYWYQQLPGTAPKLLIYRNNQQPLGVPDRFSGSKSGTSASLAISGLRSEDEADYYCSTWDDALSIRVFGGGTKLTVL (SEQ ID NO: 1715) |
| 189 | AIP-102833 | EVQLVESGGALVKPGGSLRLSCAASGFVYSKAWMSWVRQAPGKGLEWVGRIKSVTDGQATDYAAPVKGRFTISRDDSKSTLYLQMNSLKTEDTAVYYCTSSFCCRGGSCPSHDTSYCGGQYKSYYYMDVWGKGTTVTVSS (SEQ ID NO: 1522) | QSVLTQPPSASGTPGQRVTISCSGSSSNIGSSSVSWYQQLPGTAPKLLIYKNTQRASGVPDRFSGSKSGTSASLAISGLRSEDEADYYCSTWDDALNVRVFGGGTKLTVL (SEQ ID NO: 1716) |
| 190 | AIP-173396 | EVQLVESGGALVKPGGSLRLSCAASGFVFSKAWMSWVRQAPGKGLEWVGRIKSVTDGETTDYAAPVKGRFTISRDDSKSTLYLQMNSLKTEDTAVYYCTSSFCCRGKSCPSHDTSYCGGQYASYYYMDVWGKGTTVTVSS (SEQ ID NO: 1523) | QSVLTQPPSASGTPGQRVTISCSGSSSNIGSSSVSWYQQLPGTAPKLLIYRNNQQPLGVPDRFSGSKSGTSASLAISGLRSEDEADYYCSSWDDSSLVRVFGGGTKLTVL (SEQ ID NO: 1717) |
| 191 | AIP-132355 | EVQLVESGGALVKPGGSLRLSCAASGFTFAKAWMSWVRQAPGKGLEWVGRIKSVTDAETTDYAAPVKGRFTISRDDSKSTLYLQMNSLKTEDTAVYYCTSSFCCRSGSCPSSDTSYCNGQYKSYYWMDVWGKGTTVIVSS (SEQ ID NO: 1524) | QSVLTQPPSASGTPGQRVTISCSGSSSNIGSSSVTWYQQLPGTAPKLLIYKNNARPSGVPDRFSGSKSGTSASLAISGLRSEDEADYYCATWDNSLSIRVFGGGTKLTVL (SEQ ID NO: 1718) |
| 192 | AIP-118505 | EVQLVESGGALVKPGGSLRLSCAASGFTYAKAWFTWVRQAPGKGLEWVGRIKSTSDGGITDYAAPVKGRFTISRDDSKSTLYLQMNSLKTEDTAVYYCTSSFCCRGGSCPSHDTSFCGGQYKSYYYMDVWGKGTTVTVSS (SEQ ID NO: 1525) | QSVLTQPPSASGTPGQRVTISCSGSKSNIGSSYVSWYQQLPGTAPKLLIYKDNQRASGVPDRFSGSKSGTSASLAISGLRSEDEADYYCSTWDDALSVRVFGGGTKLTVL (SEQ ID NO: 1719) |
| 193 | AIP-131972 | EVQLVESGGALVKPGGSLRLSCAASGFTFSKAWMSWVRQAPGKGLEWVGRIKSVSDGETTDYAAPVKGRFTISRDDSKSTLYLQMNSLKTEDTAVYYCTSSFCCRGGSCPSRDTSYCGGQYKSYYFMDVWGKGTTVTVSS (SEQ ID NO: 1526) | QSVLTQPPSASGTPGQRVTISCSGSSSNIGSSSVYWYQQLPGTAPKLLIYKNNQRPSGVPDRFSGSKSGTSASLAISGLRSEDEADYYCSTWDDSLSVRVFGGGTKLTVL (SEQ ID NO: 1720) |
| 194 | AIP-189526 | EVQLVESGGGLVKPGGSLRLSCAASGFTFSKAWMTWVRQAPGKGLEWVGRIKSTSDGGITDYAAPVKGRFTISRDDSKNTLYLQMNSLKTEDTAVYYCTTSFCCRGGRCPSRDTSFCGGQYNSYYYMDVWGQGTTVTVSS (SEQ ID NO: 1725) | QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL (SEQ ID NO: 1726 |

TABLE 2B

| | AIP Number | HCDR1 | HCDR2 | HCDR3 | LCDR1 | LCDR2 | LCDR3 |
|---|---|---|---|---|---|---|---|
| 19 | AIP-148327 | GFTFSKAWMT (SEQ ID NO: 169) | RIKSVTEGETTDYAAPVKG (SEQ ID NO: 363) | TSSFCCRGGSCPSHDTSFCGCQDKRYYYMDV (SEQ ID NO: 557) | SGSSSNIGSSSVS (SEQ ID NO: 751) | KNNQRPS (SEQ ID NO: 945) | STWDESLSVRV (SEQ ID NO: 1139) |
| 19 | AIP-198092 | GFTFSKAWMT (SEQ ID NO: 170) | RIKSVTEGETTDYAAPVKG (SEQ ID NO: 364) | TSSFCCRGGSCPSHDTSFCGGQDKRYYYMDV (SEQ ID NO: 558) | SGSSSNIGSSSVS (SEQ ID NO: 752) | KNNQRPS (SEQ ID NO: 946) | STWDESLSVRV (SEQ ID NO: 1140) |

TABLE 2B-continued

| | AIP Number | HCDR1 | HCDR2 | HCDR3 | LCDR1 | LCDR2 | LCDR3 |
|---|---|---|---|---|---|---|---|
| 19 | AIP-184490 | GFTFSKAWMT (SEQ ID NO: 171) | RIKSVTDGETTDYAAPVKG (SEQ ID NO: 365) | TSSFCCRGGSCPSHDTSFCGGSYKSYYYMDV (SEQ ID NO: 559) | SGSSSNIGSSSVS (SEQ ID NO: 753) | KNNQRPS (SEQ ID NO: 947) | STWDESLSVRV (SEQ ID NO: 1141) |
| 19 | AIP-102396 | GFTFSKAWMS (SEQ ID NO: 172) | RIKSVTDGETTDYAAPVKG (SEQ ID NO: 366) | TSSFCCRGGSCPSHDTSYCGGQYKSYYYMDV (SEQ ID NO: 560) | SGSSSNIGSSSVS (SEQ ID NO: 754) | KNNQRPS (SEQ ID NO: 948) | STWDESLSVRV (SEQ ID NO: 1142) |
| 20 | AIP-150055 | GYTFSKAWMS (SEQ ID NO: 173) | RIKSVTDGETTDYAAPVKG (SEQ ID G NO: 367) | TSSFCCRGGSCPSHDTSYCGGQYKSYYYMDV (SEQ ID NO: 561) | SGSSSNIGSSSVS (SEQ ID NO: 755) | KNNQRPS (SEQ ID NO: 949) | STWDDSLSVRV (SEQ ID NO: 1143) |
| 20 | AIP-167084 | GFDFSKAWMS (SEQ ID NO: 174) | RIKSVTDGETTDYAAPVKG (SEQ ID NO: 368) | TSSFCCRGGSCPSHDTSYCGGQYKSYYYMDV (SEQ ID NO: 562) | SGSSSNIGSSSVS (SEQ ID NO: 756) | KNNQRPS (SEQ ID NO: 950) | STWDDSLSVRV (SEQ ID NO: 1144) |
| 20 | AIP-185304 | GFVFSKAWMS (SEQ ID NO: 175) | RIKSVTDGETTDYAAPVKG (SEQ ID NO: 369) | TSSFCCRGGSCPSHDTSYCGGQYKSYYYMDV (SEQ ID NO: 563) | SGSSSNIGSSSVS (SEQ ID NO: 757) | KNNQRPS (SEQ ID NO: 951) | STWDDSLSVRV (SEQ ID NO: 1145) |
| 20 | AIP-134770 | GFTYSKAWMS (SEQ ID NO: 176) | RIKSVTDGETTDYAAPVKG (SEQ ID NO: 370) | TSSFCCRGGSCPSHDTSYCGGQYKSYYYMDV (SEQ ID NO: 564) | SGSSSNIGSSSVS (SEQ ID NO: 758) | KNNQRPS (SEQ ID NO: 952) | STWDDSLSVRV (SEQ ID NO: 1146) |
| 20 | AIP-141887 | GFTFAKAWMS (SEQ ID NO: 177) | RIKSVTDGETTDYAAPVKG (SEQ ID NO: 371) | TSSFCCRGGSCPSHDTSYCGGQYKSYYYMDV (SEQ ID NO: 565) | SGSSSNIGSSSVS (SEQ ID NO: 759) | KNNQRPS (SEQ ID NO: 953) | STWDDSLSVRV (SEQ ID NO: 1147) |
| 20 | AIP-196203 | GFTFSNAWMS (SEQ ID NO: 178) | RIKSVTDGETTDYAAPVKG (SEQ ID NO: 372) | TSSFCCRGGSCPSHDTSYCGGQYKSYYYMDV (SEQ ID NO: 566) | SGSSSNIGSSSVS (SEQ ID NO: 760) | KNNQRPS (SEQ ID NO: 954) | STWDDSLSVRV (SEQ ID NO: 1148) |
| 20 | AIP-184151 | GFTFSRAWMS (SEQ ID NO: 179) | RIKSVTDGETTDYAAPVKG (SEQ ID NO: 373) | TSSFCCRGGSCPSHDTSYCGGQYKSYYYMDV (SEQ ID NO: 567) | SGSSSNIGSSSVS (SEQ ID NO: 761) | KNNQRPS (SEQ ID NO: 955) | STWDDSLSVRV (SEQ ID NO: 1149) |
| 20 | AIP-128195 | GFTFSMAWMS (SEQ ID NO: 180) | RIKSVTDGETTDYAAPVKG (SEQ ID NO: 374) | TSSFCCRGGSCPSHDTSYCGGQYKSYYYMDV (SEQ ID NO: 568) | SGSSSNIGSSSVS (SEQ ID NO: 762) | KNNQRPS (SEQ ID NO: 956) | STWDDSLSVRV (SEQ ID NO: 1150) |
| 20 | AIP-116579 | GFTFSAAWMS (SEQ ID NO: 181) | RIKSVTDGETTDYAAPVKG (SEQ ID NO: 375) | TSSFCCRGGSCPSHDTSYCGGQYKSYYYMDV (SEQ ID NO: 569) | SGSSSNIGSSSVS (SEQ ID NO: 763) | KNNQRPS (SEQ ID NO: 957) | STWDDSLSVRV (SEQ ID NO: 1151) |
| 20 | AIP-192329 | GFTFSHAWMS (SEQ ID NO: 182) | RIKSVTDGETTDYAAPVKG (SEQ ID NO: 376) | TSSFCCRGGSCPSHDTSYCGGQYKSYYYMDV (SEQ ID NO: 570) | SGSSSNIGSSSVS (SEQ ID NO: 764) | KNNQRPS (SEQ ID NO: 958) | STWDDSLSVRV (SEQ ID NO: 1152) |
| 21 | AIP-192329 | GFTFSHAWMS (SEQ ID NO: 183) | RIKSVTDGETTDYAAPVKG (SEQ ID NO: 377) | TSSFCCRGGSCPSHDTSYCGGQYKSYYYMDV (SEQ ID NO: 571) | SGSSSNIGSSSVS (SEQ ID NO: 765) | KNNQRPS (SEQ ID NO: 959) | STWDDSLSVRV (SEQ ID NO: 1153) |

TABLE 2B-continued

| | AIP Number | HCDR1 | HCDR2 | HCDR3 | LCDR1 | LCDR2 | LCDR3 |
|---|---|---|---|---|---|---|---|
| 21 | AIP-197809 | GFTFSKAYMS (SEQ ID NO: 184) | RIKSVTDGETTDYAAPVKG (SEQ ID NO: 378) | TSSFCCRGGSCPSHDTSYCGGQYKSYYYMDV (SEQ ID NO: 572) | SGSSSNIGSSSVS (SEQ ID NO: 766) | KNNQRPS (SEQ ID NO: 960) | STWDDSLSVRV (SEQ ID NO: 1154) |
| 21 | AIP-142489 | GFTFSKAWFS (SEQ ID NO: 185) | RIKSVTDGETTDYAAPVKG (SEQ ID NO: 379) | TSSFCCRGGSCPSHDTSYCGGQYKSYYYMDV (SEQ ID NO: 573) | SGSSSNIGSSSVS (SEQ ID NO: 767) | KNNQRPS (SEQ ID NO: 961) | STWDDSLSVRV (SEQ ID NO: 1155) |
| 21 | AIP-148102 | GFTFSKAWMS (SEQ ID NO: 186) | RIQSVTDGETTDYAAPVKG (SEQ ID NO: 380) | TSSFCCRGGSCPSHDTSYCGGQYKSYYYMDV (SEQ ID NO: 574) | SGSSSNIGSSSVS (SEQ ID NO: 768) | KNNQRPS (SEQ ID NO: 962) | STWDDSLSVRV (SEQ ID NO: 1156) |
| 21 | AIP-167726 | GFTFSKAWMS (SEQ ID NO: 187) | RIKAVTDGETTDYAAPVKG (SEQ ID NO: 381) | TSSFCCRGGSCPSHDTSYCGGQYKSYYYMDV (SEQ ID NO: 575) | SGSSSNIGSSSVS (SEQ ID NO: 769) | KNNQRPS (SEQ ID NO: 963) | STWDDSLSVRV (SEQ ID NO: 1157) |
| 21 | AIP-199834 | GFTFSKAWMS (SEQ ID NO: 188) | RIKSATDGETTDYAAPVKG (SEQ ID NO: 382) | TSSFCCRGGSCPSHDTSYCGGQYKSYYYMDV (SEQ ID NO: 576) | SGSSSNIGSSSVS (SEQ ID NO: 770) | KNNQRPS (SEQ ID NO: 964) | STWDDSLSVRV (SEQ ID NO: 1158) |
| 21 | AIP-143179 | GFTFSKAWMS (SEQ ID NO: 189) | RIKSNTDGETTDYAAPVKG (SEQ ID NO: 383) | TSSFCCRGGSCPSHDTSYCGGQYKSYYYMDV (SEQ ID NO: 577) | SGSSSNIGSSSVS (SEQ ID NO: 771) | KNNQRPS (SEQ ID NO: 965) | STWDDSLSVRV (SEQ ID NO: 1159) |
| 21 | AIP-195587 | GFTFSKAWMS (SEQ ID NO: 190) | RIKSVHDGETTDYAAPVKG (SEQ ID NO: 384) | TSSFCCRGGSCPSHDTSYCGGQYKSYYYMDV (SEQ ID NO: 578) | SGSSSNIGSSSVS (SEQ ID NO: 772) | KNNQRPS (SEQ ID NO: 966) | STWDDSLSVRV (SEQ ID NO: 1160) |
| 21 | AIP-153462 | GFTFSKAWMS (SEQ ID NO: 191) | RIKSVDDGETTDYAAPVKG (SEQ ID NO: 385) | TSSFCCRGGSCPSHDTSYCGGQYKSYYYMDV (SEQ ID NO: 579) | SGSSSNIGSSSVS (SEQ ID NO: 773) | KNNQRPS (SEQ ID NO: 967) | STWDDSLSVRV (SEQ ID NO: 1161) |
| 21 | AIP-115363 | GFTFSKAWMS (SEQ ID NO: 192) | RIKSVQDGETTDYAAPVKG (SEQ ID NO: 386) | TSSFCCRGGSCPSHDTSYCGGQYKSYYYMDV (SEQ ID NO: 580) | SGSSSNIGSSSVS (SEQ ID NO: 774) | KNNQRPS (SEQ ID NO: 968) | STWDDSLSVRV (SEQ ID NO: 1162) |
| 22 | AIP-151090 | GFTFSKAWMS (SEQ ID NO: 193) | RIKSVTNGETTDYAAPVKG (SEQ ID NO: 386) | TSSFCCRGGSCPSHDTSYCGGQYKSYYYMDV (SEQ ID NO: 581) | SGSSSNIGSSSVS (SEQ ID NO: 775) | KNNQRPS (SEQ ID NO: 969) | STWDDSLSVRV (SEQ ID NO: 1163) |
| 22 | AIP-168083 | GFTFSKAWMS (SEQ ID NO: 194) | RIKSVTDAETTDYAAPVKG (SEQ ID NO: 388) | TSSFCCRGGSCPSHDTSYCGGQYKSYYYMDV (SEQ ID NO: 582) | SGSSSNIGSSSVS (SEQ ID NO: 776) | KNNQRPS (SEQ ID NO: 970) | STWDDSLSVRV (SEQ ID NO: 1164) |
| 22 | AIP-161082 | GFTFSKAWMS (SEQ ID NO: 195) | RIKSVTDGQTTDYAAPVKG (SEQ ID NO: 389) | TSSFCCRGGSCPSHDTSYCGGQYKSYYYMDV (SEQ ID NO: 583) | SGSSSNIGSSSVS (SEQ ID NO: 777) | KNNQRPS (SEQ ID NO: 971) | STWDDSLSVRV (SEQ ID NO: 1165) |
| 22 | AIP-114196 | GFTFSKAWMS (SEQ ID NO: 196) | RIKSVTDGHTTDYAAPVKG (SEQ ID NO: 390) | TSSFCCRGGSCPSHDTSYCGGQYKSYYYMDV (SEQ ID NO: 584) | SGSSSNIGSSSVS (SEQ ID NO: 778) | KNNQRPS (SEQ ID NO: 972) | STWDDSLSVRV (SEQ ID NO: 1166) |

TABLE 2B-continued

| | AIP Number | HCDR1 | HCDR2 | HCDR3 | LCDR1 | LCDR2 | LCDR3 |
|---|---|---|---|---|---|---|---|
| 22 | AIP-189338 | GFTFSKAWMS (SEQ ID NO: 197) | RIKSVTDGEQTDYAAPVKG (SEQ ID NO: 391) | TSSFCCRGGSCPSHDTSYCGGQYKSYYYMDV (SEQ ID NO: 585) | SGSSSNIGSSSVS (SEQ ID NO: 779) | KNNQRPS (SEQ ID NO: 973) | STWDDSLSVRV (SEQ ID NO: 1167) |
| 22 | AIP-183190 | GFTFSKAWMS (SEQ ID NO: 198) | RIKSVTDGEATDYAAPVKG (SEQ ID NO: 392) | TSSFCCRGGSCPSHDTSYCGGQYKSYYYMDV (SEQ ID NO: 586) | SGSSSNIGSSSVS (SEQ ID NO: 780) | KNNQRPS (SEQ ID NO: 974) | STWDDSLSVRV (SEQ ID NO: 1168) |
| 22 | AIP-110143 | GFTFSKAWMS (SEQ ID NO: 199) | RIKSVTDGETTDYASPVKG (SEQ ID NO: 393) | TSSFCCRGGSCPSHDTSYCGGQYKSYYYMDV (SEQ ID NO: 587) | SGSSSNIGSSSVS (SEQ ID NO: 781) | KNNQRPS (SEQ ID NO: 975) | STWDDSLSVRV (SEQ ID NO: 1169) |
| 22 | AIP-147176 | GFTFSKAWMS (SEQ ID NO: 200) | RIKSVTDGETTDYAAPVQG (SEQ ID NO: 394) | TSSFCCRGGSCPSHDTSYCGGQYKSYYYMDV (SEQ ID NO: 588) | SGSSSNIGSSSVS (SEQ ID NO: 782) | KNNQRPS (SEQ ID NO: 976) | STWDDSLSVRV (SEQ ID NO: 1170) |
| 22 | AIP-134312 | GFTFSKAWMS (SEQ ID NO: 201) | RIKSVTDGETTDYAAPVKG (SEQ ID NO: 395) | ISSFCCRGGSCPSHDTSYCGGQYKSYYYMDV (SEQ ID NO: 589) | SGSSSNIGSSSVS (SEQ ID NO: 783) | KNNQRPS (SEQ ID NO: 977) | STWDDSLSVRV (SEQ ID NO: 1171) |
| 22 | AIP-128243 | GFTFSKAWMS (SEQ ID NO: 202) | RIKSVTDGETTDYAAPVKG (SEQ ID NO: 396) | TTSFCCRGGSCPSHDTSYCGGQYKSYYYMDV (SEQ ID NO: 590) | SGSSSNIGSSSVS (SEQ ID NO: 784) | KNNQRPS (SEQ ID NO: 978) | STWDDSLSVRV (SEQ ID NO: 1172) |
| 23 | AIP-156172 | GFTFSKAWMS (SEQ ID NO: 203) | RIKSVTDGETTDYAAPVKG (SEQ ID NO: 397) | TSPFCCRGGSCPSHDTSYCGGQYKSYYYMDV (SEQ ID NO: 591) | SGSSSNIGSSSVS (SEQ ID NO: 785) | KNNQRPS (SEQ ID NO: 979) | STWDDSLSVRV (SEQ ID NO: 1173) |
| 23 | AIP-147389 | GFTFSKAWMS (SEQ ID NO: 204) | RIKSVTDGETTDYAAPVKG (SEQ ID NO: 398) | TSAFCCRGGSCPSHDTSYCGGQYKSYYYMDV (SEQ ID NO: 592) | SGSSSNIGSSSVS (SEQ ID NO: 786) | KNNQRPS (SEQ ID NO: 980) | STWDDSLSVRV (SEQ ID NO: 1174) |
| 23 | AIP-124314 | GFTFSKAWMS (SEQ ID NO: 205) | RIKSVTDGETTDYAAPVKG (SEQ ID NO: 399) | TSSYCCRGGSCPSHDTSYCGGQYKSYYYMDV (SEQ ID NO: 593) | SGSSSNIGSSSVS (SEQ ID NO: 787) | KNNQRPS (SEQ ID NO: 981) | STWDDSLSVRV (SEQ ID NO: 1175) |
| 23 | AIP-185291 | GFTFSKAWMS (SEQ ID NO: 206) | RIKSVTDGETTDYAAPVKG (SEQ ID NO: 400) | TSSFCCLGGSCPSHDTSYCGGQYKSYYYMDV (SEQ ID NO: 594) | SGSSSNIGSSSVS (SEQ ID NO: 788) | KNNQRPS (SEQ ID NO: 982) | STWDDSLSVRV (SEQ ID NO: 1176) |
| 23 | AIP-135247 | GFTFSKAWMS (SEQ ID NO: 207) | RIKSVTDGETTDYAAPVKG (SEQ ID NO: 401) | TSSFCCHGGSCPSHDTSYCGGQYKSYYYMDV (SEQ ID NO: 595) | SGSSSNIGSSSVS (SEQ ID NO: 789) | KNNQRPS (SEQ ID NO: 983) | STWDDSLSVRV (SEQ ID NO: 1177) |
| 23 | AIP-113513 | GFTFSKAWMS (SEQ ID NO: 208) | RIKSVTDGETTDYAAPVKG (SEQ ID NO: 402) | TSSFCCQGGSCPSHDTSYCGGQYKSYYYMDV (SEQ ID NO: 596) | SGSSSNIGSSSVS (SEQ ID NO: 790) | KNNQRPS (SEQ ID NO: 984) | STWDDSLSVRV (SEQ ID NO: 1178) |
| 23 | AIP-102299 | GFTFSKAWMS (SEQ ID NO: 209) | RIKSVTDGETTDYAAPVKG (SEQ ID NO: 403) | TSSFCCRSGSCPSHDTSYCGGQYKSYYYMDV (SEQ ID NO: 597) | SGSSSNIGSSSVS (SEQ ID NO: 791) | KNNQRPS (SEQ ID NO: 985) | STWDDSLSVRV (SEQ ID NO: 1179) |

TABLE 2B-continued

| | AIP Number | HCDR1 | HCDR2 | HCDR3 | LCDR1 | LCDR2 | LCDR3 |
|---|---|---|---|---|---|---|---|
| 23 | AIP-179097 | GFTFSKAWMS (SEQ ID NO: 210) | RIKSVTDGETTDYAAPVKG (SEQ ID NO: 404) | TSSFCCRGASCPSHDTSYCGGQYKSYYYMDV (SEQ ID NO: 598) | SGSSSNIGSSSVS (SEQ ID NO: 792) | KNNQRPS (SEQ ID NO: 986) | STWDDSLSVRV (SEQ ID NO: 1180) |
| 23 | AIP-109343 | GFTFSKAWMS (SEQ ID NO: 211) | RIKSVTDGETTDYAAPVKG (SEQ ID NO: 405) | TSSFCCRGKSCPSHDTSYCGGQYKSYYYMDV (SEQ ID NO: 599) | SGSSSNIGSSSVS (SEQ ID NO: 793) | KNNQRPS (SEQ ID NO: 987) | STWDDSLSVRV (SEQ ID NO: 1181) |
| 23 | AIP-119622 | GFTFSKAWMS (SEQ ID NO: 212) | RIKSVTDGETTDYAAPVKG (SEQ ID NO: 406) | TSSFCCRGNSCPSHDTSYCGGQYKSYYYMDV (SEQ ID NO: 600) | SGSSSNIGSSSVS (SEQ ID NO: 794) | KNNQRPS (SEQ ID NO: 988) | STWDDSLSVRV (SEQ ID NO: 1182) |
| 24 | AIP-191735 | GFTFSKAWMS (SEQ ID NO: 213) | RIKSVTDGETTDYAAPVKG (SEQ ID NO: 407) | TSSFCCRGGNCPSHDTSYCGGQYKSYYYMDV (SEQ ID NO: 601) | SGSSSNIGSSSVS (SEQ ID NO: 795) | KNNQRPS (SEQ ID NO: 989) | STWDDSLSVRV (SEQ ID NO: 1183) |
| 24 | AIP-157078 | GFTFSKAWMS (SEQ ID NO: 214) | RIKSVTDGETTDYAAPVKG (SEQ ID NO: 408) | TSSFCCRGGQCPSHDTSYCGGQYKSYYYMDV (SEQ ID NO: 602) | SGSSSNIGSSSVS (SEQ ID NO: 796) | KNNQRPS (SEQ ID NO: 990) | STWDDSLSVRV (SEQ ID NO: 1184) |
| 24 | AIP-153475 | GFTFSKAWMS (SEQ ID NO: 215) | RIKSVTDGETTDYAAPVKG (SEQ ID NO: 409) | TSSFCCRGGACPSHDTSYCGGQYKSYYYMDV (SEQ ID NO: 603) | SGSSSNIGSSSVS (SEQ ID NO: 797) | KNNQRPS (SEQ ID NO: 991) | STWDDSLSVRV (SEQ ID NO: 1185) |
| 24 | AIP-133650 | GFTFSKAWMS (SEQ ID NO: 216) | RIKSVTDGETTDYAAPVKG (SEQ ID NO: 410) | TSSFCCRGGSCASHDTSYCGGQYKSYYYMDV (SEQ ID NO: 604) | SGSSSNIGSSSVS (SEQ ID NO: 798) | KNNQRPS (SEQ ID NO: 992) | STWDDSLSVRV (SEQ ID NO: 1186) |
| 24 | AIP-190915 | GFTFSKAWMS (SEQ ID NO: 217) | RIKSVTDGETTDYAAPVKG (SEQ ID NO: 411) | TSSFCCRGGSCLSHDTSYCGGQYKSYYYMDV (SEQ ID NO: 605) | SGSSSNIGSSSVS (SEQ ID NO: 799) | KNNQRPS (SEQ ID NO: 993) | STWDDSLSVRV (SEQ ID NO: 1187) |
| 24 | AIP-105241 | GFTFSKAWMS (SEQ ID NO: 218) | RIKSVTDGETTDYAAPVKG (SEQ ID NO: 412) | TSSFCCRGGSCPAHDTSYCGGQYKSYYYMDV (SEQ ID NO: 606) | SGSSSNIGSSSVS (SEQ ID NO: 800) | KNNQRPS (SEQ ID NO: 994) | STWDDSLSVRV (SEQ ID NO: 1188) |
| 24 | AIP-167400 | GFTFSKAWMS (SEQ ID NO: 219) | RIKSVTDGETTDYAAPVKG (SEQ ID NO: 413) | TSSFCCRGGSCPNHDTSYCGGQYKSYYYMDV (SEQ ID NO: 607) | SGSSSNIGSSSVS (SEQ ID NO: 801) | KNNQRPS (SEQ ID NO: 995) | STWDDSLSVRV (SEQ ID NO: 1189) |
| 24 | AIP-109729 | GFTFSKAWMS (SEQ ID NO: 220) | RIKSVTDGETTDYAAPVKG (SEQ ID NO: 413) | TSSFCCRGGSCPSSDTSYCGGQYKSYYYMDV (SEQ ID NO: 608) | SGSSSNIGSSSVS (SEQ ID NO: 802) | KNNQRPS (SEQ ID NO: 996) | STWDDSLSVRV (SEQ ID NO: 1190) |
| 24 | AIP-151709 | GFTFSKAWMS (SEQ ID NO: 221) | RIKSVTDGETTDYAAPVKG (SEQ ID NO: 415) | TSSFCCRGGSCPSQDTSYCGGQYKSYYYMDV (SEQ ID NO: 609) | SGSSSNIGSSSVS (SEQ ID NO: 803) | KNNQRPS (SEQ ID NO: 997) | STWDDSLSVRV (SEQ ID NO: 1191) |
| 24 | AIP-137169 | GFTFSKAWMS (SEQ ID NO: 222) | RIKSVTDGETTDYAAPVKG (SEQ ID NO: 416) | TSSFCCRGGSCPSHETSYCGGQYKSYYYMDV (SEQ ID NO: 610) | SGSSSNIGSSSVS (SEQ ID NO: 804) | KNNQRPS (SEQ ID NO: 998) | STWDDSLSVRV (SEQ ID NO: 1192) |

TABLE 2B-continued

| | AIP Number | HCDR1 | HCDR2 | HCDR3 | LCDR1 | LCDR2 | LCDR3 |
|---|---|---|---|---|---|---|---|
| 25 | AIP-199616 | GFTFSKAWMS (SEQ ID NO: 223) | RIKSVTDGETTDYAAPVKG (SEQ ID NO: 417) | TSSFCCRGGSCPSHDQSYCGGQYKSYYYMDV (SEQ ID NO: 611) | SGSSSNIGSSSVS (SEQ ID NO: 805) | KNNQRPS (SEQ ID NO: 999) | STWDDSLSVRV (SEQ ID NO: 1193) |
| 25 | AIP-189296 | GFTFSKAWMS (SEQ ID NO: 224) | RIKSVTDGETTDYAAPVKG (SEQ ID NO: 418) | TSSFCCRGGSCPSHDTSMCGGQYKSYYYMDV (SEQ ID NO: 612) | SGSSSNIGSSSVS (SEQ ID NO: 806) | KNNQRPS (SEQ ID NO: 1000) | STWDDSLSVRV (SEQ ID NO: 1194) |
| 25 | AIP-152283 | GFTFSKAWMS (SEQ ID NO: 225) | RIKSVTDGETTDYAAPVKG (SEQ ID NO: 419) | TSSFCCRGGSCPSHDTSYCAGQYKSYYYMDV (SEQ ID NO: 613) | SGSSSNIGSSSVS (SEQ ID NO: 807) | KNNQRPS (SEQ ID NO: 1001) | STWDDSLSVRV (SEQ ID NO: 1195) |
| 25 | AIP-136628 | GFTFSKAWMS (SEQ ID NO: 226) | RIKSVTDGETTDYAAPVKG (SEQ ID NO: 420) | TSSFCCRGGSCPSHDTSYCNGQYKSYYYMDV (SEQ ID NO: 614) | SGSSSNIGSSSVS (SEQ ID NO: 808) | KNNQRPS (SEQ ID NO: 1002) | STWDDSLSVRV (SEQ ID NO: 1196) |
| 25 | AIP-100340 | GFTFSKAWMS (SEQ ID NO: 227) | RIKSVTDGETTDYAAPVKG (SEQ ID NO: 421) | TSSFCCRGGSCPSHDTSYCGNQYKSYYYMDV (SEQ ID NO: 615) | SGSSSNIGSSSVS (SEQ ID NO: 809) | KNNQRPS (SEQ ID NO: 1003) | STWDDSLSVRV (SEQ ID NO: 1197) |
| 25 | AIP-166959 | GFTFSKAWMS (SEQ ID NO: 228) | RIKSVTDGETTDYAAPVKG (SEQ ID NO: 422) | TSSFCCRGGSCPSHDTSYCGAQYKSYYYMDV (SEQ ID NO: 616) | SGSSSNIGSSSVS (SEQ ID NO: 810) | KNNQRPS (SEQ ID NO: 1004) | STWDDSLSVRV (SEQ ID NO: 1198) |
| 25 | AIP-190362 | GFTFSKAWMS (SEQ ID NO: 229) | RIKSVTDGETTDYAAPVKG (SEQ ID NO: 423) | TSSFCCRGGSCPSHDTSYCGGSYKSYYYMDV (SEQ ID NO: 617) | SGSSSNIGSSSVS (SEQ ID NO: 811) | KNNQRPS (SEQ ID NO: 1005) | STWDDSLSVRV (SEQ ID NO: 1199) |
| 25 | AIP-101601 | GFTFSKAWMS (SEQ ID NO: 230) | RIKSVTDGETTDYAAPVKG (SEQ ID NO: 424) | TSSFCCRGGSCPSHDTSYCGGYYKSYYYMDV (SEQ ID NO: 618) | SGSSSNIGSSSVS (SEQ ID NO: 812) | KNNQRPS (SEQ ID NO: 1006) | STWDDSLSVRV (SEQ ID NO: 1200) |
| 25 | AIP-159023 | GFTFSKAWMS (SEQ ID NO: 231) | RIKSVTDGETTDYAAPVKG (SEQ ID NO: 425) | TSSFCCRGGSCPSHDTSYCGGQFKSYYYMDV (SEQ ID NO: 619) | SGSSSNIGSSSVS (SEQ ID NO: 813) | KNNQRPS (SEQ ID NO: 1007) | STWDDSLSVRV (SEQ ID NO: 1201) |
| 25 | AIP-146871 | GFTFSKAWMS (SEQ ID NO: 232) | RIKSVTDGETTDYAAPVKG (SEQ ID NO: 426) | TSSFCCRGGSCPSHDTSYCGGQYPSYYYMDV (SEQ ID NO: 620) | SGSSSNIGSSSVS (SEQ ID NO: 814) | KNNQRPS (SEQ ID NO: 1008) | STWDDSLSVRV (SEQ ID NO: 1202) |
| 26 | AIP-170053 | GFTFSKAWMS (SEQ ID NO: 233) | RIKSVTDGETTDYAAPVKG (SEQ ID NO: 427) | TSSFCCRGGSCPSHDTSYCGGQYASYYYMDV (SEQ ID NO: 621) | SGSSSNIGSSSVS (SEQ ID NO: 815) | KNNQRPS (SEQ ID NO: 1009) | STWDDSLSVRV (SEQ ID NO: 1203) |
| 26 | AIP-199483 | GFTFSKAWMS (SEQ ID NO: 234) | RIKSVTDGETTDYAAPVKG (SEQ ID NO: 428) | TSSFCCRGGSCPSHDTSYCGGQYQSYYYMDV (SEQ ID NO: 622) | SGSSSNIGSSSVS (SEQ ID NO: 816) | KNNQRPS (SEQ ID NO: 1010) | STWDDSLSVRV (SEQ ID NO: 1204) |
| 26 | AIP-161048 | GFTFSKAWMS (SEQ ID NO: 235) | RIKSVTDGETTDYAAPVKG (SEQ ID NO: 429) | TSSFCCRGGSCPSHDTSYCGGQYKDYYYMDV (SEQ ID NO: 623) | SGSSSNIGSSSVS (SEQ ID NO: 817) | KNNQRPS (SEQ ID NO: 1011) | STWDDSLSVRV (SEQ ID NO: 1205) |

TABLE 2B-continued

| | AIP Number | HCDR1 | HCDR2 | HCDR3 | LCDR1 | LCDR2 | LCDR3 |
|---|---|---|---|---|---|---|---|
| 26 | AIP-162041 | GFTFSKAWMS (SEQ ID NO: 236) | RIKSVTDGETTDYAAPVKG (SEQ ID NO: 430) | TSSFCCRGGSCPSHDTSYCGGQYKSFYYMDV (SEQ ID NO: 624) | SGSSSNIGSSSVS (SEQ ID NO: 818) | KNNQRPS (SEQ ID NO: 1012) | STWDDSLSVRV (SEQ ID NO: 1206) |
| 26 | AIP-197886 | GFTFSKAWMS (SEQ ID NO: 237) | RIKSVTDGETTDYAAPVKG (SEQ ID NO: 431) | TSSFCCRGGSCPSHDTSYCGGQYKSYFYMDV (SEQ ID NO: 625) | SGSSSNIGSSSVS (SEQ ID NO: 819) | KNNQRPS (SEQ ID NO: 1013) | STWDDSLSVRV (SEQ ID NO: 1207) |
| 26 | AIP-183133 | GFTFSKAWMS (SEQ ID NO: 238) | RIKSVTDGETTDYAAPVKG (SEQ ID NO: 432) | TSSFCCRGGSCPSHDTSYCGGQYKSYYWMDV (SEQ ID NO: 626) | SGSSSNIGSSSVS (SEQ ID NO: 820) | KNNQRPS (SEQ ID NO: 1014) | STWDDSLSVRV (SEQ ID NO: 1208) |
| 26 | AIP-191470 | GFTFSKAWMS (SEQ ID NO: 239) | RIKSVTDGETTDYAAPVKG (SEQ ID NO: 433) | TSSFCCRGGSCPSHDTSYCGGQYKSYYLMDV (SEQ ID NO: 627) | SGSSSNIGSSSVS (SEQ ID NO: 821) | KNNQRPS (SEQ ID NO: 1015) | STWDDSLSVRV (SEQ ID NO: 1209) |
| 26 | AIP-151167 | GFTFSKAWMS (SEQ ID NO: 240) | RIKSVTDGETTDYAAPVKG (SEQ ID NO: 434) | TSSFCCRGGSCPSHDTSYCGGQYKSYYYVDV (SEQ ID NO: 628) | SGSSSNIGSSSVS (SEQ ID NO: 822) | KNNQRPS (SEQ ID NO: 1016) | STWDDSLSVRV (SEQ ID NO: 1210) |
| 26 | AIP-106633 | GFTFSKAWMS (SEQ ID NO: 241) | RIKSVTDGETTDYAAPVKG (SEQ ID NO: 435) | TSSFCCRGGSCPSHDTSYCGGQYKSYYYFDV (SEQ ID NO: 629) | SGSSSNIGSSSVS (SEQ ID NO: 823) | KNNQRPS (SEQ ID NO: 1017) | STWDDSLSVRV (SEQ ID NO: 1211) |
| 26 | AIP-102624 | GFTFSKAWMS (SEQ ID NO: 242) | RIKSVTDGETTDYAAPVKG (SEQ ID NO: 436) | TSSFCCRGGSCPSHDTSYCGGQYKSYYYMNV (SEQ ID NO: 630) | SGSSSNIGSSSVS (SEQ ID NO: 824) | KNNQRPS (SEQ ID NO: 1018) | STWDDSLSVRV (SEQ ID NO: 1212) |
| 27 | AIP-109484 | GFTFSKAWMS (SEQ ID NO: 243) | RIKSVTDGETTDYAAPVKG (SEQ ID NO: 437) | TSSFCCRGGSCPSHDTSYCGGQYKSYYYMDI (SEQ ID NO: 631) | SGSSSNIGSSSVS (SEQ ID NO: 825) | KNNQRPS (SEQ ID NO: 1019) | STWDDSLSVRV (SEQ ID NO: 1213) |
| 27 | AIP-164754 | GFTFSKAWMS (SEQ ID NO: 244) | RIKSVTDGETTDYAAPVKG (SEQ ID NO: 438) | TSSFCCRGGSCPSHDTSYCGGQYKSYYYMDP (SEQ ID NO: 632) | SGSSSNIGSSSVS (SEQ ID NO: 826) | KNNQRPS (SEQ ID NO: 1020) | STWDDSLSVRV (SEQ ID NO: 1214) |
| 27 | AIP-169676 | GFTFSKAWMS (SEQ ID NO: 245) | RIKSVTDGETTDYAAPVKG (SEQ ID NO: 439) | TSSFCCRGGSCPSHDTSYCGGQFKDYYYMDV (SEQ ID NO: 633) | SGSSSNIGSSSVS (SEQ ID NO: 827) | KNNQRPS (SEQ ID NO: 1021) | STWDDSLSVRV (SEQ ID NO: 1215) |
| 27 | AIP-177584 | GFTFSKAWMS (SEQ ID NO: 246) | RIKSVTDGETTDYAAPVKG (SEQ ID NO: 440) | TSSFCCRGGSCPSHDTSYCGGQSKQYYYMDV (SEQ ID NO: 634) | SGSSSNIGSSSVS (SEQ ID NO: 828) | KNNQRPS (SEQ ID NO: 1022) | STWDDSLSVRV (SEQ ID NO: 1216) |
| 27 | AIP-174676 | GFTFSKAWMS (SEQ ID NO: 247) | RIKSVTDGETTDYAAPVKG (SEQ ID NO: 441) | TSSFCCRGGSCPSHDTSYCGGQSKKYYYMDV (SEQ ID NO: 635) | SGSSSNIGSSSVS (SEQ ID NO: 829) | KNNQRPS (SEQ ID NO: 1023) | STWDDSLSVRV (SEQ ID NO: 1217) |
| 27 | AIP-120546 | GFTFSKAWMS (SEQ ID NO: 248) | RIKSVTDGETTDYAAPVKG (SEQ ID NO: 442) | TSSFSCRGGSCPSHDTSYSGGQYKSYYYMDV (SEQ ID NO: 636) | SGSSSNIGSSSVS (SEQ ID NO: 830) | KNNQRPS (SEQ ID NO: 1024) | STWDDSLSVRV (SEQ ID NO: 1218) |

TABLE 2B-continued

| | AIP Number | HCDR1 | HCDR2 | HCDR3 | LCDR1 | LCDR2 | LCDR3 |
|---|---|---|---|---|---|---|---|
| 27 | AIP-186435 | GFTFSKAWMS (SEQ ID NO: 249) | RIKSVTDGETTDYAAPVKG (SEQ ID NO: 443) | TSSFACRGGSCPSHDTSYVGGQYKSYYYMDV (SEQ ID NO: 637) | SGSSSNIGSSSVS (SEQ ID NO: 831) | KNNQRPS (SEQ ID NO: 1025) | STWDDSLSVRV (SEQ ID NO: 1219) |
| 27 | AIP-171074 | GFTFSKAWMS (SEQ ID NO: 250) | RIKSVTDGETTDYAAPVKG (SEQ ID NO: 444) | TSSFCCRGNSCPAHDTSYCGGQYPSYYYMDV (SEQ ID NO: 638) | SGSSSNIGSSSVS (SEQ ID NO: 832) | KNNQRPS (SEQ ID NO: 1026) | STWDDSLSVRV (SEQ ID NO: 1220) |
| 27 | AIP-163039 | GFTFSKAWMS (SEQ ID NO: 251) | RIKSVTDGETTDYAAPVKG (SEQ ID NO: 445) | TSSYCCLGGSCPSHDTSYCGGSYKSYYYMDV (SEQ ID NO: 639) | SGSSSNIGSSSVS (SEQ ID NO: 833) | KNNQRPS (SEQ ID NO: 1027) | STWDDSLSVRV (SEQ ID NO: 1221) |
| 27 | AIP-147652 | GFTFSKAWMS (SEQ ID NO: 252) | RIKSVTDGETTDYAAPVKG (SEQ ID NO: 446) | TSSFCCRGKSCPSHDNSYCGGQYASYYYMDV (SEQ ID NO: 640) | SGSSSNIGSSSVS (SEQ ID NO: 834) | KNNQRPS (SEQ ID NO: 1028) | STWDDSLSVRV (SEQ ID NO: 1222) |
| 28 | AIP-182061 | GFTFSKAWMS (SEQ ID NO: 253) | RIKSVTDGETTDYAAPVKG (SEQ ID NO: 447) | TSSYCCRGGSCPSHDTSYCGGQFKSYYYMDP (SEQ ID NO: 641) | SGSSSNIGSSSVS (SEQ ID NO: 835) | KNNQRPS (SEQ ID NO: 1029) | STWDDSLSVRV (SEQ ID NO: 1223) |
| 28 | AIP-172643 | GFTFSKAWMS (SEQ ID NO: 254) | RIKSVTDGETTDYAAPVKG (SEQ ID NO: 448) | TSTFCCRGGSCLSHDTSYCGGQYKSYYWMDV (SEQ ID NO: 642) | SGSSSNIGSSSVS (SEQ ID NO: 836) | KNNQRPS (SEQ ID NO: 1030) | STWDDSLSVRV (SEQ ID NO: 1224) |
| 28 | AIP-171912 | GFDFSKAWMS (SEQ ID NO: 255) | RIKSVTDGQTTDYAAPVKG (SEQ ID NO: 449) | TSSFCCRGGSCPSHDTSYCGGQYKSYYYMDV (SEQ ID NO: 643) | TGSSSNIGSSSVS (SEQ ID NO: 837) | KNNQRPS (SEQ ID NO: 1031) | STWDDSLSVRV (SEQ ID NO: 1225) |
| 28 | AIP-167833 | GFTFAKAWMS (SEQ ID NO: 256) | RIKSVTDGETTDYAAPVKG (SEQ ID NO: 450) | TSSFCCRGGSCPSHDTSYCGGQYKSYYYMDV (SEQ ID NO: 644) | SGSSTNIGSSSVS (SEQ ID NO: 838) | KNNYRPS (SEQ ID NO: 1032) | STWDDSLSVRV (SEQ ID NO: 1226) |
| 28 | AIP-145518 | GFDASKAWFT (SEQ ID NO: 257) | RIKSVTDGETTDYAAPVKG (SEQ ID NO: 451) | TSSFCCRGGSCPSHDTSYCGGQYKSYYYMDV (SEQ ID NO: 645) | SGSSSNIGSSSVS (SEQ ID NO: 839) | KNNQRPS (SEQ ID NO: 1033) | STWDDSLSVRV (SEQ ID NO: 1227) |
| 28 | AIP-143155 | GFTFSKAWMS (SEQ ID NO: 258) | RIKSVTDGETTDYAAPVKG (SEQ ID NO: 452) | TSSFCCRGGSCPSHDTSYCGGQYKSYYYMDV (SEQ ID NO: 646) | TGSSSNIGSSSVS (SEQ ID NO: 840) | KNNQRPS (SEQ ID NO: 1034) | STWDDSLSVRV (SEQ ID NO: 1228) |
| 28 | AIP-119664 | GFTFSKAWMS (SEQ ID NO: 259) | RIKSVTDGETTDYAAPVKG (SEQ ID NO: 453) | TSSFCCRGGSCPSHDTSYCGGQYKSYYYMDV (SEQ ID NO: 647) | SGASSNIGSSSVS (SEQ ID NO: 841) | KNNQRPS (SEQ ID NO: 1035) | STWDDSLSVRV (SEQ ID NO: 1229) |
| 28 | AIP-190526 | GFTFSKAWMS (SEQ ID NO: 260) | RIKSVTDGETTDYAAPVKG (SEQ ID NO: 454) | TSSFCCRGGSCPSHDTSYCGGQYKSYYYMDV (SEQ ID NO: 648) | SGSPSNIGSSSVS (SEQ ID NO: 842) | KNNQRPS (SEQ ID NO: 1036) | STWDDSLSVRV (SEQ ID NO: 1230) |
| 28 | AIP-114403 | GFTFSKAWMS (SEQ ID NO: 261) | RIKSVTDGETTDYAAPVKG (SEQ ID NO: 455) | TSSFCCRGGSCPSHDTSYCGGQYKSYYYMDV (SEQ ID NO: 649) | SGSKSNIGSSSVS (SEQ ID NO: 843) | KNNQRPS (SEQ ID NO: 1037) | STWDDSLSVRV (SEQ ID NO: 1231) |

TABLE 2B-continued

| | AIP Number | HCDR1 | HCDR2 | HCDR3 | LCDR1 | LCDR2 | LCDR3 |
|---|---|---|---|---|---|---|---|
| 28 | AIP-156760 | GFTFSKAWMS (SEQ ID NO: 262) | RIKSVTDGETTDYAAPVKG (SEQ ID NO: 456) | TSSFCCRGGSCPSHDTSYCGGQYKSYYYMDV (SEQ ID NO: 650) | SGSSTNIGSSSVS (SEQ ID NO: 844) | KNNQRPS (SEQ ID NO: 1038) | STWDDSLSVRV (SEQ ID NO: 1232) |
| 29 | AIP-103803 | GFTFSKAWMS (SEQ ID NO: 263) | RIKSVTDGETTDYAAPVKG (SEQ ID NO: 457) | TSSFCCRGGSCPSHDTSYCGGQYKSYYYMDV (SEQ ID NO: 651) | SGSSSDIGSSSVS (SEQ ID NO: 845) | KNNQRPS (SEQ ID NO: 1039) | STWDDSLSVRV (SEQ ID NO: 1233) |
| 29 | AIP-182722 | GFTFSKAWMS (SEQ ID NO: 264) | RIKSVTDGETTDYAAPVKG (SEQ ID NO: 458) | TSSFCCRGGSCPSHDTSYCGGQYKSYYYMDV (SEQ ID NO: 652) | SGSSSNIQSSSVS (SEQ ID NO: 846) | KNNQRPS (SEQ ID NO: 1040) | STWDDSLSVRV (SEQ ID NO: 1234) |
| 29 | AIP-195588 | GFTFSKAWMS (SEQ ID NO: 265) | RIKSVTDGETTDYAAPVKG (SEQ ID NO: 459) | TSSFCCRGGSCPSHDTSYCGGQYKSYYYMDV (SEQ ID NO: 653) | SGSSSNIGHSSVS (SEQ ID NO: 847) | KNNQRPS (SEQ ID NO: 1041) | STWDDSLSVRV (SEQ ID NO: 1235) |
| 29 | AIP-145722 | GFTFSKAWMS (SEQ ID NO: 266) | RIKSVTDGETTDYAAPVKG (SEQ ID NO: 460) | TSSFCCRGGSCPSHDTSYCGGQYKSYYYMDV (SEQ ID NO: 654) | SGSSSNIGSTSVS (SEQ ID NO: 848) | KNNQRPS (SEQ ID NO: 1042) | STWDDSLSVRV (SEQ ID NO: 1236) |
| 29 | AIP-178251 | GFTFSKAWMS (SEQ ID NO: 267) | RIKSVTDGETTDYAAPVKG (SEQ ID NO: 461) | TSSFCCRGGSCPSHDTSYCGGQYKSYYYMDV (SEQ ID NO: 655) | SGSSSNIGSNSVS (SEQ ID NO: 849) | KNNQRPS (SEQ ID NO: 1043) | STWDDSLSVRV (SEQ ID NO: 1237) |
| 29 | AIP-116142 | GFTFSKAWMS (SEQ ID NO: 268) | RIKSVTDGETTDYAAPVKG (SEQ ID NO: 462) | TSSFCCRGGSCPSHDTSYCGGQYKSYYYMDV (SEQ ID NO: 656) | SGSSSNIGSASVS (SEQ ID NO: 850) | KNNQRPS (SEQ ID NO: 1044) | STWDDSLSVRV (SEQ ID NO: 1238) |
| 29 | AIP-183350 | GFTFSKAWMS (SEQ ID NO: 269) | RIKSVTDGETTDYAAPVKG (SEQ ID NO: 463) | TSSFCCRGGSCPSHDTSYCGGQYKSYYYMDV (SEQ ID NO: 657) | SGSSSNIGSSTVS (SEQ ID NO: 851) | KNNQRPS (SEQ ID NO: 1045) | STWDDSLSVRV (SEQ ID NO: 1239) |
| 29 | AIP-127108 | GFTFSKAWMS (SEQ ID NO: 270) | RIKSVTDGETTDYAAPVKG (SEQ ID NO: 464) | TSSFCCRGGSCPSHDTSYCGGQYKSYYYMDV (SEQ ID NO: 658) | SGSSSNIGSSAVS (SEQ ID NO: 852) | KNNQRPS (SEQ ID NO: 1046) | STWDDSLSVRV (SEQ ID NO: 1240) |
| 29 | AIP-128147 | GFTFSKAWMS (SEQ ID NO: 271) | RIKSVTDGETTDYAAPVKG (SEQ ID NO: 465) | TSSFCCRGGSCPSHDTSYCGGQYKSYYYMDV (SEQ ID NO: 659) | SGSSSNIGSSYVS (SEQ ID NO: 853) | KNNQRPS (SEQ ID NO: 1047) | STWDDSLSVRV (SEQ ID NO: 1241) |
| 29 | AIP-109510 | GFTFSKAWMS (SEQ ID NO: 272) | RIKSVTDGETTDYAAPVKG (SEQ ID NO: 466) | TSSFCCRGGSCPSHDTSYCGGQYKSYYYMDV (SEQ ID NO: 660) | SGSSSNIGSSSTS (SEQ ID NO: 854) | KNNQRPS (SEQ ID NO: 1048) | STWDDSLSVRV (SEQ ID NO: 1242) |
| 30 | AIP-104086 | GFTFSKAWMS (SEQ ID NO: 273) | RIKSVTDGETTDYAAPVKG (SEQ ID NO: 467) | TSSFCCRGGSCPSHDTSYCGGQYKSYYYMDV (SEQ ID NO: 661) | SGSSSNIGSSSVA (SEQ ID NO: 855) | KNNQRPS (SEQ ID NO: 1049) | STWDDSLSVRV (SEQ ID NO: 1243) |
| 30 | AIP-143132 | GFTFSKAWMS (SEQ ID NO: 274) | RIKSVTDGETTDYAAPVKG (SEQ ID NO: 468) | TSSFCCRGGSCPSHDTSYCGGQYKSYYYMDV (SEQ ID NO: 662) | SGSSSNIGSSSVT (SEQ ID NO: 856) | KNNQRPS (SEQ ID NO: 1050) | STWDDSLSVRV (SEQ ID NO: 1244) |

TABLE 2B-continued

| | AIP Number | HCDR1 | HCDR2 | HCDR3 | LCDR1 | LCDR2 | LCDR3 |
|---|---|---|---|---|---|---|---|
| 30 | AIP-169636 | GFTFSKAWMS (SEQ ID NO: 275) | RIKSVTDGETTDYAAPVKG (SEQ ID NO: 469) | TSSFCCRGGSCPSHDTSYCGGQYKSYYYMDV (SEQ ID NO: 663) | SGSSSNIGSSSVS (SEQ ID NO: 857) | RNNQRPS (SEQ ID NO: 1051) | STWDDSLSVRV (SEQ ID NO: 1245) |
| 30 | AIP-152243 | GFTFSKAWMS (SEQ ID NO: 276) | RIKSVTDGETTDYAAPVKG (SEQ ID NO: 470) | TSSFCCRGGSCPSHDTSYCGGQYKSYYYMDV (SEQ ID NO: 664) | SGSSSNIGSSSVS (SEQ ID NO: 858) | NNNQRPS (SEQ ID NO: 1052) | STWDDSLSVRV (SEQ ID NO: 1246) |
| 30 | AIP-138776 | GFTFSKAWMS (SEQ ID NO: 277) | RIKSVTDGETTDYAAPVKG (SEQ ID NO: 471) | TSSFCCRGGSCPSHDTSYCGGQYKSYYYMDV (SEQ ID NO: 665) | SGSSSNIGSSSVS (SEQ ID NO: 859) | MNNQRPS (SEQ ID NO: 1053) | STWDDSLSVRV (SEQ ID NO: 1247) |
| 30 | AIP-103817 | GFTFSKAWMS (SEQ ID NO: 278) | RIKSVTDGETTDYAAPVKG (SEQ ID NO: 472) | TSSFCCRGGSCPSHDTSYCGGQYKSYYYMDV (SEQ ID NO: 666) | SGSSSNIGSSSVS (SEQ ID NO: 860) | ANNQRPS (SEQ ID NO: 1054) | STWDDSLSVRV (SEQ ID NO: 1248) |
| 30 | AIP-130491 | GFTFSKAWMS (SEQ ID NO: 279) | RIKSVTDGETTDYAAPVKG (SEQ ID NO: 473) | TSSFCCRGGSCPSHDTSYCGGQYKSYYYMDV (SEQ ID NO: 667) | SGSSSNIGSSSVS (SEQ ID NO: 861) | HNNQRPS (SEQ ID NO: 1055) | STWDDSLSVRV (SEQ ID NO: 1249) |
| 30 | AIP-188155 | GFTFSKAWMS (SEQ ID NO: 280) | RIKSVTDGETTDYAAPVKG (SEQ ID NO: 474) | TSSFCCRGGSCPSHDTSYCGGQYKSYYYMDV (SEQ ID NO: 668) | SGSSSNIGSSSVS (SEQ ID NO: 862) | KDNQRPS (SEQ ID NO: 1056) | STWDDSLSVRV (SEQ ID NO: 1250) |
| 30 | AIP-167246 | GFTFSKAWMS (SEQ ID NO: 281) | RIKSVTDGETTDYAAPVKG (SEQ ID NO: 475) | TSSFCCRGGSCPSHDTSYCGGQYKSYYYMDV (SEQ ID NO: 669) | SGSSSNIGSSSVS (SEQ ID NO: 863) | KNTQRPS (SEQ ID NO: 1057) | STWDDSLSVRV (SEQ ID NO: 1251) |
| 30 | AIP-106139 | GFTFSKAWMS (SEQ ID NO: 282) | RIKSVTDGETTDYAAPVKG (SEQ ID NO: 476) | TSSFCCRGGSCPSHDTSYCGGQYKSYYYMDV (SEQ ID NO: 670) | SGSSSNIGSSSVS (SEQ ID NO: 864) | KNNYRPS (SEQ ID NO: 1058) | STWDDSLSVRV (SEQ ID NO: 1252) |
| 31 | AIP-198351 | GFTFSKAWMS (SEQ ID NO: 283) | RIKSVTDGETTDYAAPVKG (SEQ ID NO: 477) | TSSFCCRGGSCPSHDTSYCGGQYKSYYYMDV (SEQ ID NO: 671) | SGSSSNIGSSSVS (SEQ ID NO: 865) | KNNARPS (SEQ ID NO: 1059) | STWDDSLSVRV (SEQ ID NO: 1253) |
| 31 | AIP-159326 | GFTFSKAWMS (SEQ ID NO: 284) | RIKSVTDGETTDYAAPVKG (SEQ ID NO: 478) | TSSFCCRGGSCPSHDTSYCGGQYKSYYYMDV (SEQ ID NO: 672) | SGSSSNIGSSSVS (SEQ ID NO: 866) | KNNLRPS (SEQ ID NO: 1060) | STWDDSLSVRV (SEQ ID NO: 1254) |
| 31 | AIP-192275 | GFTFSKAWMS (SEQ ID NO: 285) | RIKSVTDGETTDYAAPVKG (SEQ ID NO: 479) | TSSFCCRGGSCPSHDTSYCGGQYKSYYYMDV (SEQ ID NO: 673) | SGSSSNIGSSSVS (SEQ ID NO: 867) | KNNQQPS (SEQ ID NO: 1061) | STWDDSLSVRV (SEQ ID NO: 1255) |
| 31 | AIP-190761 | GFTFSKAWMS (SEQ ID NO: 286) | RIKSVTDGETTDYAAPVKG (SEQ ID NO: 480) | TSSFCCRGGSCPSHDTSYCGGQYKSYYYMDV (SEQ ID NO: 674) | SGSSSNIGSSSVS (SEQ ID NO: 868) | KNNQRAS (SEQ ID NO: 1062) | STWDDSLSVRV (SEQ ID NO: 1256) |
| 31 | AIP-166832 | GFTFSKAWMS (SEQ ID NO: 287) | RIKSVTDGETTDYAAPVKG (SEQ ID NO: 481) | TSSFCCRGGSCPSHDTSYCGGQYKSYYYMDV (SEQ ID NO: 675) | SGSSSNIGSSSVS (SEQ ID NO: 869) | KNNQRPY (SEQ ID NO: 1063) | STWDDSLSVRV (SEQ ID NO: 1257) |

TABLE 2B-continued

| | AIP Number | HCDR1 | HCDR2 | HCDR3 | LCDR1 | LCDR2 | LCDR3 |
|---|---|---|---|---|---|---|---|
| 31 | AIP-148062 | GFTFSKAWMS (SEQ ID NO: 288) | RIKSVTDGETTDYAAPVKG (SEQ ID NO: 482) | TSSFCCRGGSCPSHDTSYCGGQYKSYYYMDV (SEQ ID NO: 676) | SGSSSNIGSSSVS (SEQ ID NO: 870) | KNNQRPL (SEQ ID NO: 1064) | STWDDSLSVRV (SEQ ID NO: 1258) |
| 31 | AIP-129145 | GFTFSKAWMS (SEQ ID NO: 289) | RIKSVTDGETTDYAAPVKG (SEQ ID NO: 483) | TSSFCCRGGSCPSHDTSYCGGQYKSYYYMDV (SEQ ID NO: 677) | SGSSSNIGSSSVS (SEQ ID NO: 871) | KNNQRPS (SEQ ID NO: 1065) | ATWDDSLSVRV (SEQ ID NO: 1259) |
| 31 | AIP-111240 | GFTFSKAWMS (SEQ ID NO: 290) | RIKSVTDGETTDYAAPVKG (SEQ ID NO: 484) | TSSFCCRGGSCPSHDTSYCGGQYKSYYYMDV (SEQ ID NO: 678) | SGSSSNIGSSSVS (SEQ ID NO: 872) | KNNQRPS (SEQ ID NO: 1066) | SSWDDSLSVRV (SEQ ID NO: 1260) |
| 31 | AIP-190749 | GFTFSKAWMS (SEQ ID NO: 291) | RIKSVTDGETTDYAAPVKG (SEQ ID NO: 485) | TSSFCCRGGSCPSHDTSYCGGQYKSYYYMDV (SEQ ID NO: 679) | SGSSSNIGSSSVS (SEQ ID NO: 873) | KNNQRPS (SEQ ID NO: 1067) | STFDDSLSVRV (SEQ ID NO: 1261) |
| 31 | AIP-153888 | GFTFSKAWMS (SEQ ID NO: 292) | RIKSVTDGETTDYAAPVKG (SEQ ID NO: 486) | TSSFCCRGGSCPSHDTSYCGGQYKSYYYMDV (SEQ ID NO: 680) | SGSSSNIGSSSVS (SEQ ID NO: 874) | KNNQRPS (SEQ ID NO: 1068) | STWDNSLSVRV (SEQ ID NO: 1262) |
| 32 | AIP-130915 | GFTFSKAWMS (SEQ ID NO: 293) | RIKSVTDGETTDYAAPVKG (SEQ ID NO: 487) | TSSFCCRGGSCPSHDTSYCGGQYKSYYYMDV (SEQ ID NO: 681) | SGSSSNIGSSSVS (SEQ ID NO: 875) | KNNQRPS (SEQ ID NO: 1069) | STWDDQLSVRV (SEQ ID NO: 1263) |
| 32 | AIP-109048 | GFTFSKAWMS (SEQ ID NO: 294) | RIKSVTDGETTDYAAPVKG (SEQ ID NO: 488) | TSSFCCRGGSCPSHDTSYCGGQYKSYYYMDV (SEQ ID NO: 682) | SGSSSNIGSSSVS (SEQ ID NO: 876) | KNNQRPS (SEQ ID NO: 1070) | STWDDALSVRV (SEQ ID NO: 1264) |
| 32 | AIP-170569 | GFTFSKAWMS (SEQ ID NO: 295) | RIKSVTDGETTDYAAPVKG (SEQ ID NO: 489) | TSSFCCRGGSCPSHDTSYCGGQYKSYYYMDV (SEQ ID NO: 683) | SGSSSNIGSSSVS (SEQ ID NO: 877) | KNNQRPS (SEQ ID NO: 1071) | STWDDDLSVRV (SEQ ID NO: 1265) |
| 32 | AIP-154873 | GFTFSKAWMS (SEQ ID NO: 296) | RIKSVTDGETTDYAAPVKG (SEQ ID NO: 490) | TSSFCCRGGSCPSHDTSYCGGQYKSYYYMDV (SEQ ID NO: 684) | SGSSSNIGSSSVS (SEQ ID NO: 878) | KNNQRPS (SEQ ID NO: 1072) | STWDDSNSVRV (SEQ ID NO: 1266) |
| 32 | AIP-159037 | GFTFSKAWMS (SEQ ID NO: 297) | RIKSVTDGETTDYAAPVKG (SEQ ID NO: 491) | TSSFCCRGGSCPSHDTSYCGGQYKSYYYMDV (SEQ ID NO: 685) | SGSSSNIGSSSVS (SEQ ID NO: 879) | KNNQRPS (SEQ ID NO: 1073) | STWDDSSSVRV (SEQ ID NO: 1267) |
| 32 | AIP-186826 | GFTFSKAWMS (SEQ ID NO: 298) | RIKSVTDGETTDYAAPVKG (SEQ ID NO: 492) | TSSFCCRGGSCPSHDTSYCGGQYKSYYYMDV (SEQ ID NO: 686) | SGSSSNIGSSSVS (SEQ ID NO: 880) | KNNQRPS (SEQ ID NO: 1074) | STWDDSLNVRV (SEQ ID NO: 1268) |
| 32 | AIP-156514 | GFTFSKAWMS (SEQ ID NO: 299) | RIKSVTDGETTDYAAPVKG (SEQ ID NO: 493) | TSSFCCRGGSCPSHDTSYCGGQYKSYYYMDV (SEQ ID NO: 687) | SGSSSNIGSSSVS (SEQ ID NO: 881) | KNNQRPS (SEQ ID NO: 1075) | STWDDSLLVRV (SEQ ID NO: 1269) |
| 32 | AIP-157122 | GFTFSKAWMS (SEQ ID NO: 300) | RIKSVTDGETTDYAAPVKG (SEQ ID NO: 494) | TSSFCCRGGSCPSHDTSYCGGQYKSYYYMDV (SEQ ID NO: 688) | SGSSSNIGSSSVS (SEQ ID NO: 882) | KNNQRPS (SEQ ID NO: 1076) | STWDDSLTVRV (SEQ ID NO: 1270) |

TABLE 2B-continued

| | AIP Number | HCDR1 | HCDR2 | HCDR3 | LCDR1 | LCDR2 | LCDR3 |
|---|---|---|---|---|---|---|---|
| 32 | AIP-173276 | GFTFSKAWMS (SEQ ID NO: 301) | RIKSVTDGETTDYAAPVKG (SEQ ID NO: 495) | TSSFCCRGGSCPSHDTSYCGGQYKSYYYMDV (SEQ ID NO: 689) | SGSSSNIGSSSVS (SEQ ID NO: 883) | KNNQRPS (SEQ ID NO: 1077) | STWDDSLSIRV (SEQ ID NO: 1271) |
| 32 | AIP-150485 | GFTFSKAWMS (SEQ ID NO: 302) | RIKSVTDGETTDYAAPVKG (SEQ ID NO: 496) | TSSFCCRGGSCPSHDTSYCGGQYKSYYYMDV (SEQ ID NO: 690) | SGSSSNIGSSSVS (SEQ ID NO: 884) | KNNQRPS (SEQ ID NO: 1078) | STWDDSLSVKV (SEQ ID NO: 1272) |
| 33 | AIP-135679 | GFTFSKAWMS (SEQ ID NO: 303) | RIKSVTDGETTDYAAPVKG (SEQ ID NO: 497) | TSSFCCRGGSCPSHDTSYCGGQYKSYYYMDV (SEQ ID NO: 691) | SGSSSNIGSSSVS (SEQ ID NO: 885) | KNNQRPS (SEQ ID NO: 1079) | STWDDSLSVWV (SEQ ID NO: 1273) |
| 33 | AIP-166847 | GFTFSKAWMS (SEQ ID NO: 304) | RIKSVTDGETTDYAAPVKG (SEQ ID NO: 498) | TSSFCCRGGSCPSHDTSYCGGQYKSYYYMDV (SEQ ID NO: 692) | SGSSSNIGSSSVS (SEQ ID NO: 886) | KNNQRPS (SEQ ID NO: 1080) | STWDDSLSVHV (SEQ ID NO: 1274) |
| 33 | AIP-124013 | GFTFSKAWMS (SEQ ID NO: 305) | RIKSVTDGETTDYAAPVKG (SEQ ID NO: 499) | TSSFCCRGGSCPSHDTSYCGGQYKSYYYMDV (SEQ ID NO: 693) | SGSSSNIGSSSVS (SEQ ID NO: 887) | KNNQRPS (SEQ ID NO: 1081) | STWDDSLSVQV (SEQ ID NO: 1275) |
| 33 | AIP-126285 | GFTFSKAWMS (SEQ ID NO: 306) | RIKSVTDGETTDYAAPVKG (SEQ ID NO: 500) | TSSFCCRGGSCPSHDTSYCGGQYKSYYYMDV (SEQ ID NO: 694) | SGSSSNIGSSSVS (SEQ ID NO: 888) | KNNQRPS (SEQ ID NO: 1082) | STWDDSLSVRI (SEQ ID NO: 1276) |
| 33 | AIP-190274 | GFTFSKAWMS (SEQ ID NO: 307) | RIKSVTDGETTDYAAPVKG (SEQ ID NO: 501) | TSSFCCRGGSCPSHDTSYCGGQYKSYYYMDV (SEQ ID NO: 695) | SGSSSDIGSSSVS (SEQ ID NO: 889) | KNNQRPS (SEQ ID NO: 1083) | STWNDQLSVRV (SEQ ID NO: 1277) |
| 33 | AIP-150277 | GFTFSKAWMS (SEQ ID NO: 308) | RIKSVTDGETTDYAAPVKG (SEQ ID NO: 502) | TSSFCCRGGSCPSHDTSYCGGQYKSYYYMDV (SEQ ID NO: 696) | SGSSSDIGSHDVL (SEQ ID NO: 890) | KNNQRPS (SEQ ID NO: 1084) | STWDDSLSVRV (SEQ ID NO: 1278) |
| 33 | AIP-104364 | GFTFSKAWYS (SEQ ID NO: 309) | RIKSVTDGETTDYAAPVKG (SEQ ID NO: 503) | TSSFCCRGGSCPSHDTSYCGGQYKSYYYMDV (SEQ ID NO: 697) | SGSSSNIGSSSVS (SEQ ID NO: 891) | KNNQRPS (SEQ ID NO: 1085) | STWDDSLSVRV (SEQ ID NO: 1279) |
| 33 | AIP-180422 | GFTFSKAWMS (SEQ ID NO: 310) | RIKSVTDGETTEYAASVKG (SEQ ID NO: 504) | TSSFCCRGGSCPSHDTSYCGGQYKSYYYMDV (SEQ ID NO: 698) | SGSSSNIGSSSVS (SEQ ID NO: 892) | KNNQRPS (SEQ ID NO: 1086) | STWDDSLSVRV (SEQ ID NO: 1280) |
| 33 | AIP-166722 | GFTFSKAWMS (SEQ ID NO: 311) | RIKSVTDGETTEYAASVKG (SEQ ID NO: 505) | TSSFCCRGGSCPSHDTSYCGGQYKSYYYMDV (SEQ ID NO: 699) | SGSSSNIGSSSVS (SEQ ID NO: 893) | KNNQRPS (SEQ ID NO: 1087) | STWDDSLSVRV (SEQ ID NO: 1281) |
| 33 | AIP-193490 | GFTFSKAWMS (SEQ ID NO: 312) | FIKSVTDGETTEYAASVKG (SEQ ID NO: 506) | TSSFCCRGGSCPSHDTSYCGGQYKSYYYMDV (SEQ ID NO: 700) | SGSSSNIGSSSVS (SEQ ID NO: 894) | KNNQRPS (SEQ ID NO: 1088) | STWDDSLSVRV (SEQ ID NO: 1282) |
| 34 | AIP-129967 | GFTFSKAWMS (SEQ ID NO: 313) | RIKSVTDGETTDYAAPVKG (SEQ ID NO: 507) | TSSYCCRSGSCPSSDTSYCNGQFKSYYYMDP (SEQ ID NO: 701) | SGSSSNIGSSSVS (SEQ ID NO: 895) | KNNQRPS (SEQ ID NO: 1089) | STWDDSLSVRV (SEQ ID NO: 1283) |

TABLE 2B-continued

| | AIP Number | HCDR1 | HCDR2 | HCDR3 | LCDR1 | LCDR2 | LCDR3 |
|---|---|---|---|---|---|---|---|
| 34 | AIP-126175 | GFTFSKAWMS (SEQ ID NO: 314) | RIKSVTDGETTDYAAPVKG (SEQ ID NO: 508) | TSSFCCRSGSCPSSDTSYCNGQYKSYYYVNI (SEQ ID NO: 702) | SGSSSNIGSSSVS (SEQ ID NO: 896) | KNNQRPS (SEQ ID NO: 1090) | STWDDSLSVRV (SEQ ID NO: 1284) |
| 34 | AIP-180905 | GFTFSKAWMS (SEQ ID NO: 315) | RIKSVTDGETTDYAAPVKG (SEQ ID NO: 509) | TTSFCCRGASCPSHDTSYCAGSYKSYYYVNI (SEQ ID NO: 703) | SGSSSNIGSSSVS (SEQ ID NO: 897) | KNNQRPS (SEQ ID NO: 1091) | STWDDSLSVRV (SEQ ID NO: 1285) |
| 34 | AIP-141706 | GFTFSKAWMS (SEQ ID NO: 316) | RIKSVTDGETTDYAAPVKG (SEQ ID NO: 510) | TSAFCCRGKSCPSSDTSYCGGQYPSYYYVNI (SEQ ID NO: 704) | SGSSSNIGSSSVS (SEQ ID NO: 898) | KNNQRPS (SEQ ID NO: 1092) | STWDDSLSVRV (SEQ ID NO: 1286) |
| 34 | AIP-105092 | GFTFSKAWMS (SEQ ID NO: 317) | RIKSVTDGETTDYAAPVKG (SEQ ID NO: 511) | TSAFCCRGKSCPSHDTSFCGGQDKRYYYVNI (SEQ ID NO: 705) | SGSSSNIGSSSVS (SEQ ID NO: 899) | KNNQRPS (SEQ ID NO: 1093) | STWDDSLSVRV (SEQ ID NO: 1287) |
| 34 | AIP-152031 | GFTFSKAWMS (SEQ ID NO: 318) | RIKSVTDGETTDYAAPVKG (SEQ ID NO: 512) | TSAFCCRGGNCPSHETSYCNGQNKQYYYMDV (SEQ ID NO: 706) | SGSSSNIGSSSVS (SEQ ID NO: 900) | KNNQRPS (SEQ ID NO: 1094) | STWDDSLSVRV (SEQ ID NO: 1288) |
| 34 | AIP-163319 | GFTFSKAWMS (SEQ ID NO: 319) | RIKSVTDGETTDYAAPVKG (SEQ ID NO: 513) | TSSFCCRGNQCPSSDTSFCGGQDKRYYYMDP (SEQ ID NO: 707) | SGSSSNIGSSSVS (SEQ ID NO: 901) | KNNQRPS (SEQ ID NO: 1095) | STWDDSLSVRV (SEQ ID NO: 1289) |
| 34 | AIP-160621 | GFTFSKAWMS (SEQ ID NO: 320) | RIKSVTDGETTDYAAPVKG (SEQ ID NO: 514) | TTSFCCRGNQCPSHETSYCGGYYKSYFYMDV (SEQ ID NO: 708) | SGSSSNIGSSSVS (SEQ ID NO: 902) | KNNQRPS (SEQ ID NO: 1096) | STWDDSLSVRV (SEQ ID NO: 1290) |
| 34 | AIP-145212 | GFTFSKAWMS (SEQ ID NO: 321) | RIKSVTDGETTDYAAPVKG (SEQ ID NO: 515) | TSSYCCRGKQCPSHDTSYCAGQYADYYYMDV (SEQ ID NO: 709) | SGSSSNIGSSSVS (SEQ ID NO: 903) | KNNQRPS (SEQ ID NO: 1097) | STWDDSLSVRV (SEQ ID NO: 1291) |
| 34 | AIP-112328 | GFTFSKAWMS (SEQ ID NO: 322) | RIKSVTDGETTDYAAPVKG (SEQ ID NO: 516) | ISSFCCRGKQCPSSDTSYCNGQYADYYYMDV (SEQ ID NO: 710) | SGSSSNIGSSSVS (SEQ ID NO: 904) | KNNQRPS (SEQ ID NO: 1098) | STWDDSLSVRV (SEQ ID NO: 1292) |
| 35 | AIP-193106 | GFTFSKAWMS (SEQ ID NO: 323) | RIKSVTDGETTDYAAPVKG (SEQ ID NO: 517) | TSSFCCRGKQCPSSDTSYCNGQYADYYYVNI (SEQ ID NO: 711) | SGSSSNIGSSSVS (SEQ ID NO: 905) | KNNQRPS (SEQ ID NO: 1099) | STWDDSLSVRV (SEQ ID NO: 1293) |
| 35 | AIP-125062 | GFTFSKAWMS (SEQ ID NO: 324) | RIKSVTDGETTDYAAPVKG (SEQ ID NO: 518) | ISSFCCRGKQCPSSDTSFCGGQDKRYYFMDV (SEQ ID NO: 712) | SGSSSNIGSSSVS (SEQ ID NO: 906) | KNNQRPS (SEQ ID NO: 1100) | STWDDSLSVRV (SEQ ID NO: 1294) |
| 35 | AIP-124301 | GFTFSKAWMS (SEQ ID NO: 325) | RIKSVTDGETTDYAAPVKG (SEQ ID NO: 519) | TSAFCCRGKQCPSSDTSYCGGQYASFYYMDV (SEQ ID NO: 713) | SGSSSNIGSSSVS (SEQ ID NO: 907) | KNNQRPS (SEQ ID NO: 1101) | STWDDSLSVRV (SEQ ID NO: 1295) |
| 35 | AIP-124068 | GFTFSKAWMS (SEQ ID NO: 326) | RIKSVTDGETTDYAAPVKG (SEQ ID NO: 520) | TSSFCCQGNNCPSSDTSYCGGYYKDYYYMDV (SEQ ID NO: 714) | SGSSSNIGSSSVS (SEQ ID NO: 908) | KNNQRPS (SEQ ID NO: 1102) | STWDDSLSVRV (SEQ ID NO: 1296) |

TABLE 2B-continued

| | AIP Number | HCDR1 | HCDR2 | HCDR3 | LCDR1 | LCDR2 | LCDR3 |
|---|---|---|---|---|---|---|---|
| 35 | AIP-144568 | GFTFSKAWMS (SEQ ID NO: 327) | RIKSVTDGETTDYAAPVKG (SEQ ID NO: 521) | TSSFCCQGNNCPSHDTSYCGGQYKSYYYVNI (SEQ ID NO: 715) | SGSSSNIGSSSVS (SEQ ID NO: 909) | KNNQRPS (SEQ ID NO: 1103) | STWDDSLSVRV (SEQ ID NO: 1297) |
| 35 | AIP-139782 | GFTFSKAWMS (SEQ ID NO: 328) | RIKSVTDGETTDYAAPVKG (SEQ ID NO: 522) | TSSFCCQGKNCPSHETSYCGGQYADYYYMDV (SEQ ID NO: 716) | SGSSSNIGSSSVS (SEQ ID NO: 910) | KNNQRPS (SEQ ID NO: 1104) | STWDDSLSVRV (SEQ ID NO: 1298) |
| 35 | AIP-171543 | GFTFSKAWMS (SEQ ID NO: 329) | RIKSVTDGETTDYAAPVKG (SEQ ID NO: 523) | TTSFCCHGNSCPSSDTSYCGGQNKQYYYMDV (SEQ ID NO: 717) | SGSSSNIGSSSVS (SEQ ID NO: 911) | KNNQRPS (SEQ ID NO: 1105) | STWDDSLSVRV (SEQ ID NO: 1299) |
| 35 | AIP-140148 | GFTFSKAWMS (SEQ ID NO: 330) | RIKSVTDGETTDYAAPVKG (SEQ ID NO: 524) | ISSFCCHGNSCPSHDTSYCNGQNKQYYYMDV (SEQ ID NO: 718) | SGSSSNIGSSSVS (SEQ ID NO: 912) | KNNQRPS (SEQ ID NO: 1106) | STWDDSLSVRV (SEQ ID NO: 1300) |
| 35 | AIP-177193 | GFTFSKAWMS (SEQ ID NO: 331) | RIKSVTDGETTDYAAPVKG (SEQ ID NO: 525) | ISSFCCHSNNCPSSDTSYCNGQYKQYYYMDV (SEQ ID NO: 719) | SGSSSNIGSSSVS (SEQ ID NO: 913) | KNNQRPS (SEQ ID NO: 1107) | STWDDSLSVRV (SEQ ID NO: 1301) |
| 35 | AIP-171348 | GFTFSKAWMS (SEQ ID NO: 332) | RIKSVTDGETTDYAAPVKG (SEQ ID NO: 526) | TSSFCCHSNNCPSHDTSYCGGQYKSYYYVNI (SEQ ID NO: 720) | SGSSSNIGSSSVS (SEQ ID NO: 914) | KNNQRPS (SEQ ID NO: 1108) | STWDDSLSVRV (SEQ ID NO: 1302) |
| 36 | AIP-193088 | GFTFSKAWMS (SEQ ID NO: 333) | RIKSVTDGETTDYAAPVKG (SEQ ID NO: 527) | ISSFACHSNNCPSSDTSYVNGYYKQYYFMDV (SEQ ID NO: 721) | SGSSSNIGSSSVS (SEQ ID NO: 915) | KNNQRPS (SEQ ID NO: 1109) | STWDDSLSVRV (SEQ ID NO: 1303) |
| 36 | AIP-182087 | GFTFSKAWMS (SEQ ID NO: 334) | RIKSVTDGETTDYAAPVKG (SEQ ID NO: 528) | TSSFCCHSNNCPSSDTSYCNGQYKQYYYVNI (SEQ ID NO: 722) | SGSSSNIGSSSVS (SEQ ID NO: 916) | KNNQRPS (SEQ ID NO: 1110) | STWDDSLSVRV (SEQ ID NO: 1304) |
| 36 | AIP-151388 | GFTFSKAWMS (SEQ ID NO: 335) | RIKSVTDGETTDYAAPVKG (SEQ ID NO: 529) | TSSFCCLGKACLSHDTSYCGGQYASYYYVNI (SEQ ID NO: 723) | SGSSSNIGSSSVS (SEQ ID NO: 917) | KNNQRPS (SEQ ID NO: 1111) | STWDDSLSVRV (SEQ ID NO: 1305) |
| 36 | AIP-149787 | GFTFSKAWMS (SEQ ID NO: 336) | RIKSVTDGETTDYAAPVKG (SEQ ID NO: 530) | TSSFCCLGKACLSSDTSYCGGYYASYYFVNI (SEQ ID NO: 724) | SGSSSNIGSSSVS (SEQ ID NO: 918) | KNNQRPS (SEQ ID NO: 1112) | STWDDSLSVRV (SEQ ID NO: 1306) |
| 36 | AIP-126097 | GFTFSKAWMS (SEQ ID NO: 337) | RIKSVTDGETTDYAAPVKG (SEQ ID NO: 531) | TSSFACLGKACLSSDTSYVGGYYASYYFVNI (SEQ ID NO: 725) | SGSSSNIGSSSVS (SEQ ID NO: 919) | KNNQRPS (SEQ ID NO: 1113) | STWDDSLSVRV (SEQ ID NO: 1307) |
| 36 | AIP-107759 | GFTFSKAWMS (SEQ ID NO: 338) | RIKSVTDGETTDYAAPVKG (SEQ ID NO: 532) | TSSYCCLGNSCPSSDTSYCGGQFKSYYYMDP (SEQ ID NO: 726) | SGSSSNIGSSSVS (SEQ ID NO: 920) | KNNQRPS (SEQ ID NO: 1114) | STWDDSLSVRV (SEQ ID NO: 1308) |
| 36 | AIP-148484 | GFTFSKAWMS (SEQ ID NO: 339) | RIKSVTDGETTDYAAPVKG (SEQ ID NO: 533) | TSSYCCLGNSCPSSDTSFCGGQDKRYYYMDP (SEQ ID NO: 727) | SGSSSNIGSSSVS (SEQ ID NO: 921) | KNNQRPS (SEQ ID NO: 1115) | STWDDSLSVRV (SEQ ID NO: 1309) |

TABLE 2B-continued

| | AIP Number | HCDR1 | HCDR2 | HCDR3 | LCDR1 | LCDR2 | LCDR3 |
|---|---|---|---|---|---|---|---|
| 36 | AIP-186403 | GFTFSKAWMS (SEQ ID NO: 340) | RIKSVTDGETTDYAAPVKG (SEQ ID NO: 534) | ISSFCCLGGNCPSSETSYCGNQYPSYYYMDV (SEQ ID NO: 728) | SGSSSNIGSSSVS (SEQ ID NO: 922) | KNNQRPS (SEQ ID NO: 1116) | STWDDSLSVRV (SEQ ID NO: 1310) |
| 36 | AIP-166629 | GFTFSKAWMS (SEQ ID NO: 341) | RIKSVTDGETTDYAAPVKG (SEQ ID NO: 535) | ISSFCCLGGNCPSSETSYCGNYYPSYFYMDV (SEQ ID NO: 729) | SGSSSNIGSSSVS (SEQ ID NO: 923) | KNNQRPS (SEQ ID NO: 1117) | STWDDSLSVRV (SEQ ID NO: 1311) |
| 36 | AIP-165276 | GFTFSKAWMS (SEQ ID NO: 342) | RIKSVTDGETTDYAAPVKG (SEQ ID NO: 536) | TSSFCCLGGNCPSSETSYCGNQYPSYYYVNI (SEQ ID NO: 730) | SGSSSNIGSSSVS (SEQ ID NO: 924) | KNNQRPS (SEQ ID NO: 1118) | STWDDSLSVRV (SEQ ID NO: 1312) |
| 37 | AIP-188293 | GFTFSKAWMS (SEQ ID NO: 343) | RIKSVTDGETTDYAAPVKG (SEQ ID NO: 537) | TTSFACRGNQCPSHETSYVGGYYKSYFYMDV (SEQ ID NO: 731) | SGSSSNIGSSSVS (SEQ ID NO: 925) | KNNQRPS (SEQ ID NO: 1119) | STWDDSLSVRV (SEQ ID NO: 1313) |
| 37 | AIP-109364 | GFTFSKAWMS (SEQ ID NO: 344) | RIKSVTDGETTDYAAPVKG (SEQ ID NO: 538) | TTSFACRGNQCPSSETSYVGGYYKSYFFMDV (SEQ ID NO: 732) | SGSSSNIGSSSVS (SEQ ID NO: 926) | KNNQRPS (SEQ ID NO: 1120) | STWDDSLSVRV (SEQ ID NO: 1314) |
| 37 | AIP-191805 | GFTFSKAWMS (SEQ ID NO: 345) | RIKSVTDGETTDYAAPVKG (SEQ ID NO: 539) | ISSFACRGKQCPSSDTSYVGGQFKSYYFMDV (SEQ ID NO: 733) | SGSSSNIGSSSVS (SEQ ID NO: 927) | KNNQRPS (SEQ ID NO: 1121) | STWDDSLSVRV (SEQ ID NO: 1315) |
| 37 | AIP-181592 | GFTFAKAWMS (SEQ ID NO: 346) | RIKAADDGKQTDYAAPVKG (SEQ ID NO: 540) | TSSFCCRGGSCLSHDTSYCGGQYKSYYWMDV (SEQ ID NO: 734) | SGSSTNIGSSSVY (SEQ ID NO: 928) | KNNYRPS (SEQ ID NO: 1122) | STWDDSLSVRV (SEQ ID NO: 1316) |
| 37 | AIP-155587 | GFTYAKAWMS (SEQ ID NO: 347) | RIKSVQDGEQTDYAAPVKG (SEQ ID NO: 541) | TSSYCCLGGSCPSHDTSYCGGSYKSYYYMDV (SEQ ID NO: 735) | SGSSTNIGSSSVY (SEQ ID NO: 929) | KNNYRAS (SEQ ID NO: 1123) | STWDDSLSVRV (SEQ ID NO: 1317) |
| 37 | AIP-147945 | GFDASKAWFT (SEQ ID NO: 348) | RIKSVTDGETTDYAAPVKG (SEQ ID NO: 542) | TSSFCCRGGSCPSHDTSYCGGQNKQYYYMDV (SEQ ID NO: 736) | TGSSSNIGSSYVS (SEQ ID NO: 930) | KNSLRPQ (SEQ ID NO: 1124) | STWDDSLSVRV (SEQ ID NO: 1318) |
| 37 | AIP-199264 | GFDASKAWFT (SEQ ID NO: 349) | RIKSVTDGETTDYAAPVKG (SEQ ID NO: 543) | TSSFACRGGSCPSHDTSYVGGQYKSYYYMDV (SEQ ID NO: 737) | TGSSSNIGSSYVS (SEQ ID NO: 931) | KNSLRPQ (SEQ ID NO: 1125) | STWDDSLSVRV (SEQ ID NO: 1319) |
| 37 | AIP-123438 | GFDASKAWFT (SEQ ID NO: 350) | RIKSVTDGETTDYAAPVKG (SEQ ID NO: 544) | TSSYCCLGGSCPSHDTSYCGGSYKSYYYMDV (SEQ ID NO: 738) | TGSSSNIGSSYVS (SEQ ID NO: 932) | KNSLRPQ (SEQ ID NO: 1126) | STWDDSLSVRV (SEQ ID NO: 1320) |
| 37 | AIP-151315 | GFDASKAWFT (SEQ ID NO: 351) | RIKSVTDGETTDYAAPVKG (SEQ ID NO: 545) | TSSFCCRGKSCPSHDTSYCGGQYASYYYMDV (SEQ ID NO: 739) | TGSSSNIGSSYVS (SEQ ID NO: 933) | KNSLRPQ (SEQ ID NO: 1127) | STWDDSLSVRV (SEQ ID NO: 1321) |
| 37 | AIP-197785 | GFTFSKAWMS (SEQ ID NO: 352) | RIKAADDGKQTDYAAPVKG (SEQ ID NO: 546) | TSSFCCRGGNCPSHETSYCGNQYKSYYYMDV (SEQ ID NO: 740) | SGSPSNIGSASTS (SEQ ID NO: 934) | KNNQRPS (SEQ ID NO: 1128) | STWDDSLSVRV (SEQ ID NO: 1322) |

TABLE 2B-continued

| | AIP Number | HCDR1 | HCDR2 | HCDR3 | LCDR1 | LCDR2 | LCDR3 |
|---|---|---|---|---|---|---|---|
| 38 | AIP-115782 | GFTFSKAWMS (SEQ ID NO: 353) | RIKAADDGKQTDYAAPVKG (SEQ ID NO: 547) | TSSFCCRSGSCPSSDTSYCNGQYKSYYYMDV (SEQ ID NO: 741) | SGSPSNIGSASTS (SEQ ID NO: 935) | KNNQRPS (SEQ ID NO: 1129) | STWDDSLSVRV (SEQ ID NO: 1323) |
| 38 | AIP-138130 | GFTFSKAWMS (SEQ ID NO: 354) | RIKAADDGKQTDYAAPVKG (SEQ ID NO: 548) | TSSFCCRGGSCPSHDTSYCGGQYKSYYYVNI (SEQ ID NO: 742) | SGSPSNIGSASTS (SEQ ID NO: 936) | KNNQRPS (SEQ ID NO: 1130) | STWDDSLSVRV (SEQ ID NO: 1324) |
| 38 | AIP-170221 | GFTFSKAWMS (SEQ ID NO: 355) | RIKAADDGKQTDYAAPVKG (SEQ ID NO: 549) | TTSFCCRGASCPSHDTSYCAGSYKSYYYMDV (SEQ ID NO: 743) | SGSPSNIGSASTS (SEQ ID NO: 937) | KNNQRPS (SEQ ID NO: 1131) | STWDDSLSVRV (SEQ ID NO: 1325) |
| 38 | AIP-167482 | GFTFSKAWMS (SEQ ID NO: 356) | RIKAADDGKQTDYAAPVKG (SEQ ID NO: 550) | ISSFCCRGNSCPSSDTSYCNGQYKSYYYMDV (SEQ ID NO: 744) | SGSPSNIGSASTS (SEQ ID NO: 938) | KNNQRPS (SEQ ID NO: 1132) | STWDDSLSVRV (SEQ ID NO: 1326) |
| 38 | AIP-189475 | GFTFSKAWMS (SEQ ID NO: 357) | RIKAVTDGHTTDYAAPVKG (SEQ ID NO: 551) | TSSFCCRGGSCPSHDTSYCGGQYKSYYYMDV (SEQ ID NO: 745) | SGASSNIGHSSVY (SEQ ID NO: 939) | RNNQQPL (SEQ ID NO: 1133) | STWDDALSIRV (SEQ ID NO: 1327) |
| 38 | AIP-102833 | GFVYSKAWMS (SEQ ID NO: 358) | RIKSVTDGQATDYAAPVKG (SEQ ID NO: 552) | TSSFCCRGGSCPSHDTSYCGGQYKSYYYMDV (SEQ ID NO: 746) | SGSSSNIGSSSVS (SEQ ID NO: 940) | KNTQRAS (SEQ ID NO: 1134) | STWDDALNVRV (SEQ ID NO: 1328) |
| 38 | AIP-173396 | GFVFSKAWMS (SEQ ID NO: 359) | RIKSVTDGETTDYAAPVKG (SEQ ID NO: 553) | TSSFCCRGKSCPSHDTSYCGGQYASYYYMDV (SEQ ID NO: 747) | SGSSSNIGSSSVS (SEQ ID NO: 941) | RNNQQPL (SEQ ID NO: 1135) | SSWDDSSLVRV (SEQ ID NO: 1329) |
| 38 | AIP-132355 | GFTFAKAWMS (SEQ ID NO: 360) | RIKSVTDAETTDYAAPVKG (SEQ ID NO: 554) | TSSFCCRSGSCPSSDTSYCNGQYKSYYWMDV (SEQ ID NO: 748) | SGSSSNIGSSSVT (SEQ ID NO: 942) | KNNARPS (SEQ ID NO: 1136) | ATWDNSLSIRV (SEQ ID NO: 1330) |
| 38 | AIP-118505 | GFTYAKAWFT (SEQ ID NO: 361) | RIKSTSDGGITDYAAPVKG (SEQ ID NO: 555) | TSSFCCRGGSCPSHDTSFCGGQYKSYYYMDV (SEQ ID NO: 749) | SGSKSNIGSSYVS (SEQ ID NO: 943) | KDNQRAS (SEQ ID NO: 1137) | STWDDALSVRV (SEQ ID NO: 1331) |
| 38 | AIP-131972 | GFTFSKAWMS (SEQ ID NO: 362) | RIKSVSDGETTDYAAPVKG (SEQ ID NO: 556) | TSSFCCRGGSCPSRDTSYCGGQYKSYYFMDV (SEQ ID NO: 750) | SGSSSNIGSSSVY (SEQ ID NO: 944) | KNNQRPS (SEQ ID NO: 1138) | STWDDSLSVRV (SEQ ID NO: 1332) |
| 39 | AIP-189526 | GFTFSKAWMT (SEQ ID NO: 171) | RIKSTSDGGITDYAAPVKG (SEQ ID NO: 555) | TTSFCCRGGRCPSRDTSFCGGQYNSYYYMDV (SEQ ID NO: 1727) | SGSSSNIGSSSVS (SEQ ID NO: 48) | KNNQRPS (SEQ ID NO: 1138) | STWDDSLSVRV (SEQ ID NO: 1332) |

SEQUENCE LISTING (1772 sequences)

SEQ ID NO: 1 - protein, 10 aa, Artificial Sequence
  Description of Artificial Sequence: Synthetic peptide
GFTFSKAWMS

SEQ ID NO: 2 - protein, 10 aa, Artificial Sequence
  Description of Artificial Sequence: Synthetic peptide
GFTYSAAWMS

SEQ ID NO: 3 - protein, 10 aa, Artificial Sequence
  Description of Artificial Sequence: Synthetic peptide
GFTFSMAWMS

SEQ ID NO: 4 - protein, 10 aa, Artificial Sequence
  Description of Artificial Sequence: Synthetic peptide
GFTFSAAWMS

SEQ ID NO: 5 - protein, 10 aa, Artificial Sequence
  Description of Artificial Sequence: Synthetic peptide
GFTYSKAWMS

SEQ ID NO: 6 - protein, 10 aa, Artificial Sequence
  Description of Artificial Sequence: Synthetic peptide
GFTFAKAWMS

SEQ ID NO: 7 - protein, 10 aa, Artificial Sequence
  Description of Artificial Sequence: Synthetic peptide
GFVFSKAWMS

SEQ ID NO: 8 - protein, 10 aa, Artificial Sequence
  Description of Artificial Sequence: Synthetic peptide
GFTFSKAWMT

SEQ ID NO: 9 - protein, 19 aa, Artificial Sequence
  Description of Artificial Sequence: Synthetic peptide
RIKSVTDGETTDYAAPVKG

SEQ ID NO: 10 - protein, 19 aa, Artificial Sequence
  Description of Artificial Sequence: Synthetic peptide
RIKAVHDGETTDYAAPVKG

SEQ ID NO: 11 - protein, 19 aa, Artificial Sequence
  Description of Artificial Sequence: Synthetic peptide
RIKSNTDAETTDYAAPVKG

SEQ ID NO: 12 - protein, 19 aa, Artificial Sequence
  Description of Artificial Sequence: Synthetic peptide
RIKSVQDGETTDYAAPVKG

SEQ ID NO: 13 - protein, 19 aa, Artificial Sequence
  Description of Artificial Sequence: Synthetic peptide
RIKSVTDGHTTDYAAPVKG

SEQ ID NO: 14 - protein, 19 aa, Artificial Sequence
  Description of Artificial Sequence: Synthetic peptide
RIKSVTDGGITDYAAPVKG

SEQ ID NO: 15 - protein, 19 aa, Artificial Sequence
  Description of Artificial Sequence: Synthetic peptide
RIKSTSDGETTDYAAPVKG

SEQ ID NO: 16 - protein, 19 aa, Artificial Sequence
  Description of Artificial Sequence: Synthetic peptide
RIKSTSDGGITDYAAPVKG

SEQ ID NO: 17 - protein, 19 aa, Artificial Sequence
  Description of Artificial Sequence: Synthetic peptide
RIKSVTEGETTDYAAPVKG

SEQ ID NO: 18 - protein, 19 aa, Artificial Sequence
  Description of Artificial Sequence: Synthetic peptide
RIKSVTDGEQTDYAAPVKG

SEQ ID NO: 19 - protein, 19 aa, Artificial Sequence
  Description of Artificial Sequence: Synthetic peptide
RIKAADDGKQTDYAAPVKG

SEQ ID NO: 20 - protein, 31 aa, Artificial Sequence
  Description of Artificial Sequence: Synthetic polypeptide
TSSFCCRSGSCPSSDTSYCNGQYKSYYYMDV

SEQ ID NO: 21 - protein, 31 aa, Artificial Sequence
  Description of Artificial Sequence: Synthetic polypeptide
TSSFCCRGGSCPSHDTSYCGGQYKSYYYMDV

SEQ ID NO: 22 - protein, 31 aa, Artificial Sequence
  Description of Artificial Sequence: Synthetic polypeptide
TTSFCCRGASCPSSDTSYCAGSYKSYYFVNI

SEQ ID NO: 23 - protein, 31 aa, Artificial Sequence
  Description of Artificial Sequence: Synthetic polypeptide
TSSFCCRGNQCPSSDTSYCGGQYPSYYYMDP

SEQ ID NO: 24 - protein, 31 aa, Artificial Sequence
  Description of Artificial Sequence: Synthetic polypeptide
ISSFCCRGKQCPSSDTSYCNGYYADYYFMDV

SEQ ID NO: 25 - protein, 31 aa, Artificial Sequence
  Description of Artificial Sequence: Synthetic polypeptide
ISSFCCRGKQCPSSDTSYCGGQFKSYYFMDV

SEQ ID NO: 26 - protein, 31 aa, Artificial Sequence
  Description of Artificial Sequence: Synthetic polypeptide
ISSFCCHSNNCPSSDTSYCNGYYKQYYFMDV

SEQ ID NO: 27 - protein, 31 aa, Artificial Sequence
  Description of Artificial Sequence: Synthetic polypeptide
ISSFCCRGNSCPSSDTSYCNGQYKSYYYMDV

SEQ ID NO: 28 - protein, 31 aa, Artificial Sequence
  Description of Artificial Sequence: Synthetic polypeptide
TSSFCCRGGSCPSHDTSYCGGQYKSFYYMDV

SEQ ID NO: 29 - protein, 31 aa, Artificial Sequence
  Description of Artificial Sequence: Synthetic polypeptide
ISSFCCRGNSCPSSDTSYCNGQYKSYYFMDV

SEQ ID NO: 30 - protein, 31 aa, Artificial Sequence
  Description of Artificial Sequence: Synthetic polypeptide
ISSFCCRGGSCPSRDTSYCGGQYKSYYFMDV

SEQ ID NO: 31 - protein, 31 aa, Artificial Sequence
  Description of Artificial Sequence: Synthetic polypeptide
TSSFCCRGGSCPSSDTSYCGGYYKSYYFMDV

SEQ ID NO: 32 - protein, 31 aa, Artificial Sequence
  Description of Artificial Sequence: Synthetic polypeptide
TSSFCCRGGSCPSSDTSYCGGQYKSYYFMDV

SEQ ID NO: 33 - protein, 31 aa, Artificial Sequence
  Description of Artificial Sequence: Synthetic polypeptide
TSSFCCRGGSCPSHDTSYCGGYYKSYYYMDV

SEQ ID NO: 34 - protein, 31 aa, Artificial Sequence
  Description of Artificial Sequence: Synthetic polypeptide
TSSFCCRGGSCPSHDTSFCGGQDKRYYYMDV

SEQ ID NO: 35 - protein, 31 aa, Artificial Sequence
  Description of Artificial Sequence: Synthetic polypeptide
TTSFCCRGGSCPSHDTSFCGGQDKRYYYMDV

SEQ ID NO: 36 - protein, 31 aa, Artificial Sequence
  Description of Artificial Sequence: Synthetic polypeptide
TSSFCCRGGSCPSHDTSFCGGQYNRYYYMDV

SEQ ID NO: 37 - protein, 31 aa, Artificial Sequence
  Description of Artificial Sequence: Synthetic polypeptide
TSSFCCRGGSCPSHDTSFCGGQYKSYYYMDV

SEQ ID NO: 38 - protein, 31 aa, Artificial Sequence
  Description of Artificial Sequence: Synthetic polypeptide
TTSFCCRGGRCPSRDTSFCGGQYNSYYYMDV

SEQ ID NO: 39 - protein, 31 aa, Artificial Sequence
  Description of Artificial Sequence: Synthetic polypeptide
TTSFCCRGGSCPSHDTSFCGGQYKSYYYMDV

SEQ ID NO: 40 - protein, 31 aa, Artificial Sequence
  Description of Artificial Sequence: Synthetic polypeptide
TSSFCCRGGSCPSHDTSFCGGQDSRYYYMDV

SEQ ID NO: 41 - protein, 31 aa, Artificial Sequence
  Description of Artificial Sequence: Synthetic polypeptide
TSSFCCRGGSCPSHDTSFCGGSYKSYYYMDV

SEQ ID NO: 42 - protein, 31 aa, Artificial Sequence
  Description of Artificial Sequence: Synthetic polypeptide
TSSFCCRGGSCPSHDTSYCGGQDSRYYYMDV

SEQ ID NO: 43 - protein, 31 aa, Artificial Sequence
  Description of Artificial Sequence: Synthetic polypeptide
TSSFCCRGGSCPSHDTSYCGGQYKSYYFMDV

SEQ ID NO: 44 - protein, 31 aa, Artificial Sequence
  Description of Artificial Sequence: Synthetic polypeptide
TSSFCCRGGSCPSHDTSYCGGQNKQYYYMDV

SEQ ID NO: 45 - protein, 31 aa, Artificial Sequence
  Description of Artificial Sequence: Synthetic polypeptide
TSSFCCRGGNCPSHETSYCGNQYKSYYYMDV

SEQ ID NO: 46 - protein, 31 aa, Artificial Sequence
  Description of Artificial Sequence: Synthetic polypeptide
TSSFCCRGGSCPSHDTSYCGGQYKSYYYVNI

SEQ ID NO: 47 - protein, 31 aa, Artificial Sequence
  Description of Artificial Sequence: Synthetic polypeptide
TTSFCCRGASCPSHDTSYCAGSYKSYYYMDV

SEQ ID NO: 48 - protein, 13 aa, Artificial Sequence
  Description of Artificial Sequence: Synthetic peptide
SGSSSNIGSSSVS

SEQ ID NO: 49 - protein, 13 aa, Artificial Sequence
  Description of Artificial Sequence: Synthetic peptide
SGSSTNIGSSSVT

SEQ ID NO: 50 - protein, 13 aa, Artificial Sequence
  Description of Artificial Sequence: Synthetic peptide
SGSKSNIGSSYVS

SEQ ID NO: 51 - protein, 13 aa, Artificial Sequence
  Description of Artificial Sequence: Synthetic peptide
SGSKSNIGSSSVS

SEQ ID NO: 52 - protein, 13 aa, Artificial Sequence
  Description of Artificial Sequence: Synthetic peptide
SGASSNIGSSSVS

SEQ ID NO: 53 - protein, 13 aa, Artificial Sequence
  Description of Artificial Sequence: Synthetic peptide
SGSSTNIGSSTVS

SEQ ID NO: 54 - protein, 13 aa, Artificial Sequence
  Description of Artificial Sequence: Synthetic peptide
SGSSTNIGSSSVS

SEQ ID NO: 55 - protein, 13 aa, Artificial Sequence
  Description of Artificial Sequence: Synthetic peptide
SGSKSNIGSSSVY

SEQ ID NO: 56 - protein, 13 aa, Artificial Sequence
  Description of Artificial Sequence: Synthetic peptide
SGSSSNIGSSSVY

SEQ ID NO: 57 - protein, 13 aa, Artificial Sequence
  Description of Artificial Sequence: Synthetic peptide
SGSSSDIGSSSVS

SEQ ID NO: 58 - protein, 13 aa, Artificial Sequence
  Description of Artificial Sequence: Synthetic peptide
SGSPSNIGSSSVS

SEQ ID NO: 59 - protein, 7 aa, Artificial Sequence
  Description of Artificial Sequence: Synthetic peptide
KNNQRPS

SEQ ID NO: 60 - protein, 7 aa, Artificial Sequence
  Description of Artificial Sequence: Synthetic peptide
KDNQRPL

SEQ ID NO: 61 - protein, 7 aa, Artificial Sequence
  Description of Artificial Sequence: Synthetic peptide
MNNQRPY

SEQ ID NO: 62 - protein, 7 aa, Artificial Sequence
  Description of Artificial Sequence: Synthetic peptide
KDNQRPS

SEQ ID NO: 63 - protein, 7 aa, Artificial Sequence
  Description of Artificial Sequence: Synthetic peptide
KNTQRAS

SEQ ID NO: 64 - protein, 7 aa, Artificial Sequence
  Description of Artificial Sequence: Synthetic peptide
KNNARPY

SEQ ID NO: 65 - protein, 7 aa, Artificial Sequence
  Description of Artificial Sequence: Synthetic peptide
KNTQRPS

SEQ ID NO: 66 - protein, 7 aa, Artificial Sequence
  Description of Artificial Sequence: Synthetic peptide
KNNQRPY

SEQ ID NO: 67 - protein, 7 aa, Artificial Sequence
  Description of Artificial Sequence: Synthetic peptide
KNSLRPQ

SEQ ID NO: 68 - protein, 11 aa, Artificial Sequence
  Description of Artificial Sequence: Synthetic peptide
STWDDSLSVRV

SEQ ID NO: 69 - protein, 11 aa, Artificial Sequence
  Description of Artificial Sequence: Synthetic peptide
ATWDDQLSVRV

SEQ ID NO: 70 - protein, 11 aa, Artificial Sequence
  Description of Artificial Sequence: Synthetic peptide
ATWDNSLSIRV

SEQ ID NO: 71 - protein, 11 aa, Artificial Sequence
  Description of Artificial Sequence: Synthetic peptide
SSWDDSNSVRI

SEQ ID NO: 72 - protein, 11 aa, Artificial Sequence
  Description of Artificial Sequence: Synthetic peptide
STWDDALSVRV

SEQ ID NO: 73 - protein, 11 aa, Artificial Sequence
  Description of Artificial Sequence: Synthetic peptide
STWDESLSVRV

SEQ ID NO: 74 - protein, 11 aa, Artificial Sequence
  Description of Artificial Sequence: Synthetic peptide
STWNDALSVRV

SEQ ID NO: 75 - protein, 11 aa, Artificial Sequence
  Description of Artificial Sequence: Synthetic peptide
STWDDSLNVRV

SEQ ID NO: 76 - protein, 11 aa, Artificial Sequence
  Description of Artificial Sequence: Synthetic peptide
ATWDDSLTVRI

SEQ ID NO: 77 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRSGSCPSSDTSYCNGQYKSYYYMDVWGKGTTVTVSS

SEQ ID NO: 78 - protein, 140 aa, Artificial Sequence
  Description of Artificial Sequence: Synthetic polypeptide
EVQLVESGGGLVQPGGSLRLSCAASGFTFSKAWMSWVRQAPGKGLEWVGRIKSVTDGETTEYAASVKGRFTISRDDSKNSLYLQMNSLKTEDTAVYYCTSSFCCRGGSCPSHDTSYCGGQYKSYYYMDVWGKGTTVTVSS

SEQ ID NO: 79 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFCCRGASCPSSDTSYCAGSYKSYYFVNIWGKGTTVTVSS

SEQ ID NO: 80 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGNQCPSSDTSYCGGQYPSYYYMDPWGKGTTVTVSS

SEQ ID NO: 81 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCRGKQCPSSDTSYCNGYYADYYFMDVWGKGTTVTVSS

SEQ ID NO: 82 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCRGKQCPSSDTSYCGGQFKSYYFMDVWGKGTTVTVSS

SEQ ID NO: 83 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCHSNNCPSSDTSYCNGYYKQYYFMDVWGKGTTVTVSS

SEQ ID NO: 84 - protein, 140 aa, Artificial Sequence
  Description of Artificial Sequence: Synthetic polypeptide
EVQLVESGGALVKPGGSLRLSCAASGFTYSAAWMSWVRQAPGKGLEWVGRIKAVHDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 85 - protein, 140 aa, Artificial Sequence
  Description of Artificial Sequence: Synthetic polypeptide
EVQLVESGGALVKPGGSLRLSCAASGFTFSMAWMSWVRQAPGKGLEWVGRIKSNTDAETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 86 - protein, 140 aa, Artificial Sequence
  Description of Artificial Sequence: Synthetic polypeptide
EVQLVESGGALVKPGGSLRLSCAASGFTFSAAWMSWVRQAPGKGLEWVGRIKSVTDGETTDYAAPVKGRFTISRDDSKSTLYLQMNSLKTEDTAVYYCISSFCCRGNSCPSSDTSYCNGQYKSYYYMDVWGKGTTVTVSS

SEQ ID NO: 87 - protein, 140 aa, Artificial Sequence
  Description of Artificial Sequence: Synthetic polypeptide
EVQLVESGGALVKPGGSLRLSCAASGFTYSKAWMSWVRQAPGKGLEWVGRIKSVQDGETTDYAAPVKGRFTISRDDSKSTLYLQMNSLKTEDTAVYYCTSSFCCRGGSCPSHDTSYCGGQYKSFYYMDVWGKGTTVTVSS

SEQ ID NO: 88 - protein, 140 aa, Artificial Sequence
  Description of Artificial Sequence: Synthetic polypeptide
EVQLVESGGALVKPGGSLRLSCAASGFTFAKAWMSWVRQAPGKGLEWVGRIKSVTDGHTTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 89 - protein, 140 aa, Artificial Sequence
  Description of Artificial Sequence: Synthetic polypeptide
EVQLVESGGALVKPGGSLRLSCAASGFVFSKAWMSWVRQAPGKGLEWVGRIKSVTDGGITDYAAPVKGRFTISRDDSKSTLYLQMNSLKTEDTAVYYCISSFCCRGNSCPSSDTSYCNGQYKSYYFMDVWGKGTTVTVSS

SEQ ID NO: 90 - protein, 140 aa, Artificial Sequence
  Description of Artificial Sequence: Synthetic polypeptide
EVQLVESGGALVKPGGSLRLSCAASGFTFSAAWMSWVRQAPGKGLEWVGRIKSTSDGETTDYAAPVKGRFTISRDDSKSTLYLQMNSLKTEDTAVYYCISSFCCRGGSCPSRDTSYCGGQYKSYYFMDVWGKGTTVTVSS

SEQ ID NO: 91 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVQDGETTDYAAPVKGRFTISRDDSKSTLYLQMNSLKTEDTAVYYCTSSFCCRGGSCPSSDTSYCGGYYKSYYFMDVWGKGTTVTVSS

SEQ ID NO: 92 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSSDTSYCGGQYKSYYFMDVWGKGTTVTVSS

SEQ ID NO: 93 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVQDGETTDYAAPVKGRFTISRDDSKSTLYLQMNSLKTEDTAVYYCTSSFCCRGGSCPSHDTSYCGGYYKSYYYMDVWGKGTTVTVSS

SEQ ID NO: 94 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 95 - protein, 140 aa, Artificial Sequence
  Description of Artificial Sequence: Synthetic polypeptide
EVQLVESGGALVKPGGSLRLSCAASGFTFSKAWMTWVRQAPGKGLEWVGRIKSVTDGETTDYAAPVKGRFTISRDDSKSVLYLQMSSLKTEDTAVYFCTSSFCCRGGSCPSHDTSFCGGQDKRYYYMDVWGKGTTVTVSS

SEQ ID NO: 96 - protein, 140 aa, Artificial Sequence
  Description of Artificial Sequence: Synthetic polypeptide
EVQLVESGGGLVKPGGSLRLSCAASGFTFSKAWMTWVRQAPGKGLEWVGRIKSVTDGETTDYAAPVKGRFTISRDDSKNTLYLQMNSLKTEDTAVYYCTTSFCCRGGSCPSHDTSFCGGQDKRYYYMDVWGQGTTVTVSS

SEQ ID NO: 97 - protein, 140 aa, Artificial Sequence
  Description of Artificial Sequence: Synthetic polypeptide
EVQLVESGGALVKPGGSLRLSCAASGFTFSKAWMTWVRQAPGKGLEWVGRIKSVTDGETTDYAAPVKGRFTISRDDSKSVLYLQMSSLKTEDTAVYFCTSSFCCRGGSCPSHDTSFCGGQYNRYYYMDVWGKGTTVTVSS

SEQ ID NO: 98 - protein, 140 aa, Artificial Sequence
  Description of Artificial Sequence: Synthetic polypeptide
EVQLVESGGALVKPGGSLRLSCAASGFTFSKAWMTWVRQAPGKGLEWVGRIKSVTDGETTDYAAPVKGRFTISRDDSKSVLYLQMSSLKTEDTAVYFCTSSFCCRGGSCPSHDTSFCGGQYKSYYYMDVWGKGTTVTVSS

SEQ ID NO: 99 - protein, 140 aa, Artificial Sequence
  Description of Artificial Sequence: Synthetic polypeptide
EVQLVESGGGLVKPGGSLRLSCAASGFTFSKAWMTWVRQAPGKGLEWVGRIKSTSDGGITDYAAPVKGRFTISRDDSKNTLYLQMNSLKTEDTAVYYCTTSFCCRGGRCPSRDTSFCGGQYNSYYYMDVWGQGTTVTVSS

SEQ ID NO: 100 - protein, 140 aa, Artificial Sequence
  Description of Artificial Sequence: Synthetic polypeptide
EVQLVESGGALVKPGGSLRLSCAASGFTFSKAWMTWVRQAPGKGLEWVGRIKSVTDGETTDYAAPVKGRFTISRDDSKSTLYLQMNSLKTEDTAVYYCTSSFCCRGGSCPSHDTSFCGGQDKRYYYMDVWGKGTTVTVSS

SEQ ID NO: 101 - protein, 140 aa, Artificial Sequence
  Description of Artificial Sequence: Synthetic polypeptide
EVQLVESGGALVKPGGSLRLSCAASGFTFSKAWMTWVRQAPGKGLEWVGRIKSVTDGETTDYAAPVKGRFTISRDDSKSTLYLQMNSLKTEDTAVYYCTSSFCCRGGSCPSHDTSFCGGQYKSYYYMDVWGKGTTVTVSS

SEQ ID NO: 102 - protein, 140 aa, Artificial Sequence
  Description of Artificial Sequence: Synthetic polypeptide
EVQLVESGGGLVKPGGSLRLSCAASGFTFSKAWMTWVRQAPGKGLEWVGRIKSVTDGETTDYAAPVKGRFTISRDDSKNTLYLQMNSLKTEDTAVYYCTTSFCCRGGSCPSHDTSFCGGQYKSYYYMDVWGQGTTVTVSS

SEQ ID NO: 103 - protein, 140 aa, Artificial Sequence
  Description of Artificial Sequence: Synthetic polypeptide
EVQLVESGGALVKPGGSLRLSCAASGFTFSKAWMTWVRQAPGKGLEWVGRIKSVTDGETTDYAAPVKGRFTISRDDSKSTLYLQMNSLKTEDTAVYYCTSSFCCRGGSCPSHDTSFCGGQDSRYYYMDVWGKGTTVTVSS

SEQ ID NO: 104 - protein, 140 aa, Artificial Sequence
  Description of Artificial Sequence: Synthetic polypeptide
EVQLVESGGALVKPGGSLRLSCAASGFTFSKAWMTWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 105 - protein, 140 aa, Artificial Sequence; identical to SEQ ID NO: 101
  Description of Artificial Sequence: Synthetic polypeptide

SEQ ID NO: 106 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSFCGGQYKSYYYMDVWGKGTTVTVSS

SEQ ID NO: 107 - protein, 140 aa, Artificial Sequence
  Description of Artificial Sequence: Synthetic polypeptide
EVQLVESGGALVKPGGSLRLSCAASGFTFSKAWMTWVRQAPGKGLEWVGRIKSVTDGETTDYAAPVKGRFTISRDDSKSTLYLQMNSLKTEDTAVYYCTSSFCCRGGSCPSHDTSFCGGSYKSYYYMDVWGKGTTVTVSS

SEQ ID NO: 108 - protein, 140 aa, Artificial Sequence
  Description of Artificial Sequence: Synthetic polypeptide
EVQLVESGGALVKPGGSLRLSCAASGFTFSKAWMTWVRQAPGKGLEWVGRIKSVTDGETTDYAAPVKGRFTISRDDSKSTLYLQMNSLKTEDTAVYYCTSSFCCRGGSCPSHDTSYCGGQDSRYYYMDVWGKGTTVTVSS

SEQ ID NO: 109 - protein, 140 aa, Artificial Sequence
  Description of Artificial Sequence: Synthetic polypeptide
EVQLVESGGGLVKPGGSLRLSCAASGFTFSKAWMTWVRQAPGKGLEWVGRIKSVTEGETTDYAAPVKGRFTISRDDSKNTLYLQMNSLKTEDTAVYYCTTSFCCRGGSCPSHDTSFCGGQYKSYYYMDVWGQGTTVTVSS

SEQ ID NO: 110 - protein, 140 aa, Artificial Sequence
  Description of Artificial Sequence: Synthetic polypeptide
EVQLVESGGALVKPGGSLRLSCAASGFTFSKAWMTWVRQAPGKGLEWVGRIKSVTEGETTDYAAPVKGRFTISRDDSKSTLYLQMNSLKTEDTAVYYCTSSFCCRGGSCPSHDTSFCGGQYKSYYYMDVWGKGTTVTVSS

SEQ ID NO: 111 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYFMDVWGKGTTVTVSS

SEQ ID NO: 112 - protein, 140 aa, Artificial Sequence; identical to SEQ ID NO: 94
  Description of Artificial Sequence: Synthetic polypeptide

SEQ ID NO: 113 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQNKQYYYMDVWGKGTTVTVSS

SEQ ID NO: 114 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGNCPSHETSYCGNQYKSYYYMDVWGKGTTVTVSS

SEQ ID NO: 115 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYVNIWGKGTTVTVSS

SEQ ID NO: 116 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFCCRGASCPSHDTSYCAGSYKSYYYMDVWGKGTTVTVSS

SEQ ID NO: 117 - protein, 140 aa, Artificial Sequence; identical to SEQ ID NO: 94
  Description of Artificial Sequence: Synthetic polypeptide

SEQ ID NO: 118 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGEQTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 119 - protein, 140 aa, Artificial Sequence; identical to SEQ ID NO: 104
  Description of Artificial Sequence: Synthetic polypeptide

SEQ ID NO: 120 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKAADDGKQTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 121 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCRGNSCPSSDTSYCNGQYKSYYYMDVWGKGTTVTVSS

SEQ ID NO: 122 - protein, 140 aa, Artificial Sequence; identical to SEQ ID NO: 94
  Description of Artificial Sequence: Synthetic polypeptide

SEQ ID NO: 123 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVL

SEQ ID NO: 124 - protein, 110 aa, Artificial Sequence
  Description of Artificial Sequence: Synthetic polypeptide
QSVLTQPPSVSAAPGQKVTISCSGSSSNIGSSSVSWYQQLPGTAPKLLIYKNNQRPSGIPDRFSGSKSGTSATLGITGLQTGDEADYYCSTWDDSLSVRVFGGGTKLTVL

SEQ ID NO: 125 - protein, 110 aa, Artificial Sequence; identical to SEQ ID NO: 123
  Description of Artificial Sequence: Synthetic polypeptide

SEQ ID NO: 126 - protein, 110 aa, Artificial Sequence; identical to SEQ ID NO: 123
  Description of Artificial Sequence: Synthetic polypeptide

SEQ ID NO: 127 - protein, 110 aa, Artificial Sequence; identical to SEQ ID NO: 123
  Description of Artificial Sequence: Synthetic polypeptide

SEQ ID NO: 128 - protein, 110 aa, Artificial Sequence; identical to SEQ ID NO: 123
  Description of Artificial Sequence: Synthetic polypeptide

SEQ ID NO: 129 - protein, 110 aa, Artificial Sequence; identical to SEQ ID NO: 123
  Description of Artificial Sequence: Synthetic polypeptide

SEQ ID NO: 130 - protein, 110 aa, Artificial Sequence
  Description of Artificial Sequence: Synthetic polypeptide
QSVLTQPPSASGTPGQRVTISCSGSSTNIGSSSVTWYQQLPGTAPKLLIYKDNQRPLGVPDRFSGSKSGTSASLAISGLRSEDEADYYCSTWDDSLSVRVFGGGTKLTVL

SEQ ID NO: 131 - protein, 110 aa, Artificial Sequence
  Description of Artificial Sequence: Synthetic polypeptide
QSVLTQPPSASGTPGQRVTISCSGSKSNIGSSYVSWYQQLPGTAPKLLIYMNNQRPYGVPDRFSGSKSGTSASLAISGLRSEDEADYYCATWDDQLSVRVFGGGTKLTVL

SEQ ID NO: 132 - protein, 110 aa, Artificial Sequence
  Description of Artificial Sequence: Synthetic polypeptide
QSVLTQPPSASGTPGQRVTISCSGSKSNIGSSSVSWYQQLPGTAPKLLIYKDNQRPSGVPDRFSGSKSGTSASLAISGLRSEDEADYYCATWDNSLSIRVFGGGTKLTVL

SEQ ID NO: 133 - protein, 110 aa, Artificial Sequence
  Description of Artificial Sequence: Synthetic polypeptide
QSVLTQPPSASGTPGQRVTISCSGASSNIGSSSVSWYQQLPGTAPKLLIYKNTQRASGVPDRFSGSKSGTSASLAISGLRSEDEADYYCSSWDDSNSVRIFGGGTKLTVL

SEQ ID NO: 134 - protein, 110 aa, Artificial Sequence
  Description of Artificial Sequence: Synthetic polypeptide
QSVLTQPPSASGTPGQRVTISCSGSSTNIGSSTVSWYQQLPGTAPKLLIYKNNARPYGVPDRFSGSKSGTSASLAISGLRSEDEADYYCATWDDSLTVRIFGGGTKLTVL

SEQ ID NO: 135 - protein, 110 aa, Artificial Sequence
  Description of Artificial Sequence: Synthetic polypeptide
QSVLTQPPSASGTPGQRVTISCSGASSNIGSSSVSWYQQLPGTAPKLLIYKNTQRPSGVPDRFSGSKSGTSASLAISGLRSEDEADYYCATWDDQLSVRVFGGGTKLTVL

SEQ ID NO: 136 - protein, 110 aa, Artificial Sequence
  Description of Artificial Sequence: Synthetic polypeptide
QSVLTQPPSASGTPGQRVTISCSGSSTNIGSSSVSWYQQLPGTAPKLLIYKDNQRPSGVPDRFSGSKSGTSASLAISGLRSEDEADYYCSSWDDSNSVRIFGGGTKLTVL

SEQ ID NO: 137 - protein, 110 aa, Artificial Sequence
  Description of Artificial Sequence: Synthetic polypeptide
QSVLTQPPSASGTPGQRVTISCSGSKSNIGSSSVYWYQQLPGTAPKLLIYKNNQRPYGVPDRFSGSKSGTSASLAISGLRSEDEADYYCSTWDDALSVRVFGGGTKLTVL

SEQ ID NO: 138 - protein, 110 aa, Artificial Sequence
  Description of Artificial Sequence: Synthetic polypeptide
QSVLTQPPSASGTPGQRVTISCSGSSSNIGSSSVYWYQQLPGTAPKLLIYKNNQRPSGVPDRFSGSKSGTSASLAISGLRSEDEADYYCSTWDDALSVRVFGGGTKLTVL

SEQ ID NO: 139 - protein, 110 aa, Artificial Sequence
  Description of Artificial Sequence: Synthetic polypeptide
QSVLTQPPSASGTPGQRVTISCSGSKSNIGSSYVSWYQQLPGTAPKLLIYKNNQRPYGVPDRFSGSKSGTSASLAISGLRSEDEADYYCSTWDDSLSVRVFGGGTKLTVL

SEQ ID NO: 140 - protein, 110 aa, Artificial Sequence; identical to SEQ ID NO: 123
  Description of Artificial Sequence: Synthetic polypeptide

SEQ ID NO: 141 - protein, 110 aa, Artificial Sequence
  Description of Artificial Sequence: Synthetic polypeptide
QSVLTQAPSASETPGQRVIISCSGSSSNIGSSSVSWYQQLPGTAPKLLIYKNNQRPSGVPDRFSGSKSGTSASLAISGLRSEDEADYYCSTWDDSLSVRVFGGGTKLTVL

SEQ ID NO: 142 - protein, 110 aa, Artificial Sequence; identical to SEQ ID NO: 123
  Description of Artificial Sequence: Synthetic polypeptide

SEQ ID NO: 143 - protein, 110 aa, Artificial Sequence; identical to SEQ ID NO: 141
  Description of Artificial Sequence: Synthetic polypeptide

SEQ ID NO: 144 - protein, 110 aa, Artificial Sequence; identical to SEQ ID NO: 141
  Description of Artificial Sequence: Synthetic polypeptide

SEQ ID NO: 145 - protein, 110 aa, Artificial Sequence; identical to SEQ ID NO: 123
  Description of Artificial Sequence: Synthetic polypeptide

SEQ ID NO: 146 - protein, 110 aa, Artificial Sequence; identical to SEQ ID NO: 123
  Description of Artificial Sequence: Synthetic polypeptide

SEQ ID NO: 147 - protein, 110 aa, Artificial Sequence; identical to SEQ ID NO: 123
  Description of Artificial Sequence: Synthetic polypeptide

SEQ ID NO: 148 - protein, 110 aa, Artificial Sequence; identical to SEQ ID NO: 123
  Description of Artificial Sequence: Synthetic polypeptide

SEQ ID NO: 149 - protein, 110 aa, Artificial Sequence; identical to SEQ ID NO: 123
  Description of Artificial Sequence: Synthetic polypeptide

SEQ ID NO: 150 - protein, 110 aa, Artificial Sequence; identical to SEQ ID NO: 123
  Description of Artificial Sequence: Synthetic polypeptide

SEQ ID NO: 151 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDESLSVRVFGGGTKLTVL

SEQ ID NO: 152 - protein, 110 aa, Artificial Sequence; identical to SEQ ID NO: 123
  Description of Artificial Sequence: Synthetic polypeptide

SEQ ID NO: 153 - protein, 110 aa, Artificial Sequence; identical to SEQ ID NO: 123
  Description of Artificial Sequence: Synthetic polypeptide

SEQ ID NO: 154 - protein, 110 aa, Artificial Sequence; identical to SEQ ID NO: 151
  Description of Artificial Sequence: Synthetic polypeptide

SEQ ID NO: 155 - protein, 110 aa, Artificial Sequence; identical to SEQ ID NO: 151
  Description of Artificial Sequence: Synthetic polypeptide

SEQ ID NO: 156 - protein, 110 aa, Artificial Sequence; identical to SEQ ID NO: 151
  Description of Artificial Sequence: Synthetic polypeptide

SEQ ID NO: 157 - protein, 110 aa, Artificial Sequence; identical to SEQ ID NO: 123
  Description of Artificial Sequence: Synthetic polypeptide

SEQ ID NO: 158 - protein, 110 aa, Artificial Sequence
  Description of Artificial Sequence: Synthetic polypeptide
QSVLTQPPSASGTPGQRVTISCSGSSSNIGSSSVYWYQQLPGTAPKLLIYKNNQRPSGVPDRFSGSKSGTSASLAISGLRSEDEADYYCSTWDDSLSVRVFGGGTKLTVL

SEQ ID NO: 159 - protein, 110 aa, Artificial Sequence; identical to SEQ ID NO: 123
  Description of Artificial Sequence: Synthetic polypeptide

SEQ ID NO: 160 - protein, 110 aa, Artificial Sequence; identical to SEQ ID NO: 123
  Description of Artificial Sequence: Synthetic polypeptide

SEQ ID NO: 161 - protein, 110 aa, Artificial Sequence; identical to SEQ ID NO: 123
  Description of Artificial Sequence: Synthetic polypeptide

SEQ ID NO: 162 - protein, 110 aa, Artificial Sequence; identical to SEQ ID NO: 123
  Description of Artificial Sequence: Synthetic polypeptide

SEQ ID NO: 163 - protein, 110 aa, Artificial Sequence
  Description of Artificial Sequence: Synthetic polypeptide
QSVLTQPPSASGTPGQRVTISCSGSSSDIGSSSVSWYQQLPGTAPKLLIYKNNQRPSGVPDRFSGSKSGTSASLAISGLRSEDEADYYCSTWNDALSVRVFGGGTKLTVL

SEQ ID NO: 164 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNTQRPSGVPDRFSGSKSGTSASLAISGLRSEDEADYYCSTWDDSLNVRVFGGGTKLTVL

SEQ ID NO: 165 - protein, 110 aa, Artificial Sequence
  Description of Artificial Sequence: Synthetic polypeptide
QSVLTQPPSASGTPGQRVTISCSGSPSNIGSSSVSWYQQLPGTAPKLLIYKNNQRPSGVPDRFSGSKSGTSASLAISGLRSEDEADYYCSTWDDALSVRVFGGGTKLTVL

SEQ ID NO: 166 - protein, 110 aa, Artificial Sequence; identical to SEQ ID NO: 123
  Description of Artificial Sequence: Synthetic polypeptide

SEQ ID NO: 167 - protein, 110 aa, Artificial Sequence; identical to SEQ ID NO: 123
  Description of Artificial Sequence: Synthetic polypeptide

SEQ ID NO: 168 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNSLRPQGVPDRFSGSKSGTSASLAISGLRSEDEADYYCSTWDDSLSVRVFGGGTKLTVL

SEQ ID NO: 169 - protein, 10 aa, Artificial Sequence
  Description of Artificial Sequence: Synthetic peptide
GFTFSKAWMT

SEQ ID NO: 170 - protein, 10 aa, Artificial Sequence
  Description of Artificial Sequence: Synthetic peptide
GFTFSKAWMT

SEQ ID NO: 171 - protein, 10 aa, Artificial Sequence
  Description of Artificial Sequence: Synthetic peptide
GFTFSKAWMT

SEQ ID NO: 172 - protein, 10 aa, Artificial Sequence
  Description of Artificial Sequence: Synthetic peptide
GFTFSKAWMS

SEQ ID NO: 173 - protein, 10 aa, Artificial Sequence
  Description of Artificial Sequence: Synthetic peptide
GYTFSKAWMS

SEQ ID NO: 174 - protein, 10 aa, Artificial Sequence
  Description of Artificial Sequence: Synthetic peptide
GFDFSKAWMS

SEQ ID NO: 175 - protein, 10 aa, Artificial Sequence
  Description of Artificial Sequence: Synthetic peptide
GFVFSKAWMS

SEQ ID NO: 176 - protein, 10 aa, Artificial Sequence
  Description of Artificial Sequence: Synthetic peptide
GFTYSKAWMS

SEQ ID NO: 177 - protein, 10 aa, Artificial Sequence
  Description of Artificial Sequence: Synthetic peptide
GFTFAKAWMS

SEQ ID NO: 178 - protein, 10 aa, Artificial Sequence
  Description of Artificial Sequence: Synthetic peptide
GFTFSNAWMS

SEQ ID NO: 179 - protein, 10 aa, Artificial Sequence
  Description of Artificial Sequence: Synthetic peptide
GFTFSRAWMS

SEQ ID NO: 180 - protein, 10 aa, Artificial Sequence
  Description of Artificial Sequence: Synthetic peptide
GFTFSMAWMS

SEQ ID NO: 181 - protein, 10 aa, Artificial Sequence
  Description of Artificial Sequence: Synthetic peptide
GFTFSAAWMS

SEQ ID NO: 182 - protein, 10 aa, Artificial Sequence
  Description of Artificial Sequence: Synthetic peptide
GFTFSHAWMS

SEQ ID NO: 183 - protein, 10 aa, Artificial Sequence
  Description of Artificial Sequence: Synthetic peptide
GFTFSHAWMS

SEQ ID NO: 184 - protein, 10 aa, Artificial Sequence
  Description of Artificial Sequence: Synthetic peptide
GFTFSKAYMS

SEQ ID NO: 185 - protein, 10 aa, Artificial Sequence
  Description of Artificial Sequence: Synthetic peptide
GFTFSKAWFS

SEQ ID NO: 186 - protein, 10 aa, Artificial Sequence
  Description of Artificial Sequence: Synthetic peptide
GFTFSKAWMS

SEQ ID NO: 187 - protein, 10 aa, Artificial Sequence
  Description of Artificial Sequence: Synthetic peptide
GFTFSKAWMS

SEQ ID NO: 188 - protein, 10 aa, Artificial Sequence
  Description of Artificial Sequence: Synthetic peptide
GFTFSKAWMS

SEQ ID NO: 189 - protein, 10 aa, Artificial Sequence
  Description of Artificial Sequence: Synthetic peptide
GFTFSKAWMS

SEQ ID NO: 190 - protein, 10 aa, Artificial Sequence
  Description of Artificial Sequence: Synthetic peptide
GFTFSKAWMS

SEQ ID NO: 191 - protein, 10 aa, Artificial Sequence
  Description of Artificial Sequence: Synthetic peptide
GFTFSKAWMS

SEQ ID NO: 192 - protein, 10 aa, Artificial Sequence
  Description of Artificial Sequence: Synthetic peptide
GFTFSKAWMS

SEQ ID NO: 193 - protein, 10 aa, Artificial Sequence
  Description of Artificial Sequence: Synthetic peptide
GFTFSKAWMS

SEQ ID NO: 194 - protein, 10 aa, Artificial Sequence
  Description of Artificial Sequence: Synthetic peptide
GFTFSKAWMS

SEQ ID NO: 195 - protein, 10 aa, Artificial Sequence
  Description of Artificial Sequence: Synthetic peptide
GFTFSKAWMS

SEQ ID NO: 196 - protein, 10 aa, Artificial Sequence
  Description of Artificial Sequence: Synthetic peptide
GFTFSKAWMS

SEQ ID NO: 197 - protein, 10 aa, Artificial Sequence
  Description of Artificial Sequence: Synthetic peptide
GFTFSKAWMS

SEQ ID NO: 198 - protein, 10 aa, Artificial Sequence
  Description of Artificial Sequence: Synthetic peptide
GFTFSKAWMS

SEQ ID NO: 199 - protein, 10 aa, Artificial Sequence
  Description of Artificial Sequence: Synthetic peptide
GFTFSKAWMS

SEQ ID NO: 200 - protein, 10 aa, Artificial Sequence
  Description of Artificial Sequence: Synthetic peptide
GFTFSKAWMS

SEQ ID NO: 201 - protein, 10 aa, Artificial Sequence
  Description of Artificial Sequence: Synthetic peptide
GFTFSKAWMS

SEQ ID NO: 202 - protein, 10 aa, Artificial Sequence
  Description of Artificial Sequence: Synthetic peptide
GFTFSKAWMS

SEQ ID NO: 203 - protein, 10 aa, Artificial Sequence
  Description of Artificial Sequence: Synthetic peptide
GFTFSKAWMS

SEQ ID NO: 204 - protein, 10 aa, Artificial Sequence
  Description of Artificial Sequence: Synthetic peptide
GFTFSKAWMS

SEQ ID NO: 205 - protein, 10 aa, Artificial Sequence
  Description of Artificial Sequence: Synthetic peptide
GFTFSKAWMS

SEQ ID NO: 206 - protein, 10 aa, Artificial Sequence
  Description of Artificial Sequence: Synthetic peptide
GFTFSKAWMS

SEQ ID NO: 207 - protein, 10 aa, Artificial Sequence
  Description of Artificial Sequence: Synthetic peptide
GFTFSKAWMS

SEQ ID NO: 208 - protein, 10 aa, Artificial Sequence
  Description of Artificial Sequence: Synthetic peptide
GFTFSKAWMS

SEQ ID NO: 209 - protein, 10 aa, Artificial Sequence
  Description of Artificial Sequence: Synthetic peptide
GFTFSKAWMS

SEQ ID NO: 210 - protein, 10 aa, Artificial Sequence
  Description of Artificial Sequence: Synthetic peptide
GFTFSKAWMS

SEQ ID NO: 211 - protein, 10 aa, Artificial Sequence
  Description of Artificial Sequence: Synthetic peptide
GFTFSKAWMS

SEQ ID NO: 212 - protein, 10 aa, Artificial Sequence
  Description of Artificial Sequence: Synthetic peptide
GFTFSKAWMS

SEQ ID NO: 213 - protein, 10 aa, Artificial Sequence
  Description of Artificial Sequence: Synthetic peptide
GFTFSKAWMS

SEQ ID NO: 214 - protein, 10 aa, Artificial Sequence
  Description of Artificial Sequence: Synthetic peptide
GFTFSKAWMS

SEQ ID NO: 215 - protein, 10 aa, Artificial Sequence
  Description of Artificial Sequence: Synthetic peptide
GFTFSKAWMS

SEQ ID NO: 216 - protein, 10 aa, Artificial Sequence
  Description of Artificial Sequence: Synthetic peptide
GFTFSKAWMS

SEQ ID NO: 217 - protein, 10 aa, Artificial Sequence
  Description of Artificial Sequence: Synthetic peptide
GFTFSKAWMS

SEQ ID NO: 218 - protein, 10 aa, Artificial Sequence
  Description of Artificial Sequence: Synthetic peptide
GFTFSKAWMS

SEQ ID NO: 219 - protein, 10 aa, Artificial Sequence
  Description of Artificial Sequence: Synthetic peptide
GFTFSKAWMS

SEQ ID NO: 220 - protein, 10 aa, Artificial Sequence
  Description of Artificial Sequence: Synthetic peptide
GFTFSKAWMS

SEQ ID NO: 221 - protein, 10 aa, Artificial Sequence
  Description of Artificial Sequence: Synthetic peptide
GFTFSKAWMS

SEQ ID NO: 222 - protein, 10 aa, Artificial Sequence
  Description of Artificial Sequence: Synthetic peptide
GFTFSKAWMS

SEQ ID NO: 223 - protein, 10 aa, Artificial Sequence
  Description of Artificial Sequence: Synthetic peptide
GFTFSKAWMS

SEQ ID NO: 224 - protein, 10 aa, Artificial Sequence
  Description of Artificial Sequence: Synthetic peptide
GFTFSKAWMS

SEQ ID NO: 225 - protein, 10 aa, Artificial Sequence
  Description of Artificial Sequence: Synthetic peptide
GFTFSKAWMS

SEQ ID NO: 226 - protein, 10 aa, Artificial Sequence
  Description of Artificial Sequence: Synthetic peptide
GFTFSKAWMS

SEQ ID NO: 227 - protein, 10 aa, Artificial Sequence
  Description of Artificial Sequence: Synthetic peptide
GFTFSKAWMS

SEQ ID NO: 228 - protein, 10 aa, Artificial Sequence
  Description of Artificial Sequence: Synthetic peptide
GFTFSKAWMS

SEQ ID NO: 229 - protein, 10 aa, Artificial Sequence
  Description of Artificial Sequence: Synthetic peptide
GFTFSKAWMS

SEQ ID NO: 230 - protein, 10 aa, Artificial Sequence
  Description of Artificial Sequence: Synthetic peptide
GFTFSKAWMS

SEQ ID NO: 231 - protein, 10 aa, Artificial Sequence
  Description of Artificial Sequence: Synthetic peptide
GFTFSKAWMS

SEQ ID NO: 232 - protein, 10 aa, Artificial Sequence
  Description of Artificial Sequence: Synthetic peptide
GFTFSKAWMS

SEQ ID NO: 233 - protein, 10 aa, Artificial Sequence
  Description of Artificial Sequence: Synthetic peptide
GFTFSKAWMS

SEQ ID NO: 234 - protein, 10 aa, Artificial Sequence
  Description of Artificial Sequence: Synthetic peptide
GFTFSKAWMS

SEQ ID NO: 235 - protein, 10 aa, Artificial Sequence
  Description of Artificial Sequence: Synthetic peptide
GFTFSKAWMS

SEQ ID NO: 236 - protein, 10 aa, Artificial Sequence
  Description of Artificial Sequence: Synthetic peptide
GFTFSKAWMS

SEQ ID NO: 237 - protein, 10 aa, Artificial Sequence
  Description of Artificial Sequence: Synthetic peptide
GFTFSKAWMS

SEQ ID NO: 238 - protein, 10 aa, Artificial Sequence
  Description of Artificial Sequence: Synthetic peptide
GFTFSKAWMS

SEQ ID NO: 239 - protein, 10 aa, Artificial Sequence
  Description of Artificial Sequence: Synthetic peptide
GFTFSKAWMS

SEQ ID NO: 240 - protein, 10 aa, Artificial Sequence
  Description of Artificial Sequence: Synthetic peptide
GFTFSKAWMS

SEQ ID NO: 241 - protein, 10 aa, Artificial Sequence
  Description of Artificial Sequence: Synthetic peptide
GFTFSKAWMS

SEQ ID NO: 242 - protein, 10 aa, Artificial Sequence
  Description of Artificial Sequence: Synthetic peptide
GFTFSKAWMS

SEQ ID NO: 243 - protein, 10 aa, Artificial Sequence
  Description of Artificial Sequence: Synthetic peptide
GFTFSKAWMS

SEQ ID NO: 244 - protein, 10 aa, Artificial Sequence
  Description of Artificial Sequence: Synthetic peptide
GFTFSKAWMS

SEQ ID NO: 245 - protein, 10 aa, Artificial Sequence
  Description of Artificial Sequence: Synthetic peptide
GFTFSKAWMS

SEQ ID NO: 246 - protein, 10 aa, Artificial Sequence
  Description of Artificial Sequence: Synthetic peptide
GFTFSKAWMS

SEQ ID NO: 247 - protein, 10 aa, Artificial Sequence
  Description of Artificial Sequence: Synthetic peptide
GFTFSKAWMS

SEQ ID NO: 248 - protein, 10 aa, Artificial Sequence
  Description of Artificial Sequence: Synthetic peptide
GFTFSKAWMS

SEQ ID NO: 249 - protein, 10 aa, Artificial Sequence
  Description of Artificial Sequence: Synthetic peptide
GFTFSKAWMS

SEQ ID NO: 250 - protein, 10 aa, Artificial Sequence
  Description of Artificial Sequence: Synthetic peptide
GFTFSKAWMS

SEQ ID NO: 251 - protein, 10 aa, Artificial Sequence
  Description of Artificial Sequence: Synthetic peptide
GFTFSKAWMS

SEQ ID NO: 252 - protein, 10 aa, Artificial Sequence
  Description of Artificial Sequence: Synthetic peptide
GFTFSKAWMS

SEQ ID NO: 253 - protein, 10 aa, Artificial Sequence
  Description of Artificial Sequence: Synthetic peptide
GFTFSKAWMS

SEQ ID NO: 254 - protein, 10 aa, Artificial Sequence
  Description of Artificial Sequence: Synthetic peptide
GFTFSKAWMS

SEQ ID NO: 255 - protein, 10 aa, Artificial Sequence
  Description of Artificial Sequence: Synthetic peptide
GFDFSKAWMS

SEQ ID NO: 256 - protein, 10 aa, Artificial Sequence
  Description of Artificial Sequence: Synthetic peptide
GFTFAKAWMS

SEQ ID NO: 257 - protein, 10 aa, Artificial Sequence
  Description of Artificial Sequence: Synthetic peptide
GFDASKAWFT

SEQ ID NO: 258 - protein, 10 aa, Artificial Sequence
  Description of Artificial Sequence: Synthetic peptide
GFTFSKAWMS

SEQ ID NO: 259 - protein, 10 aa, Artificial Sequence
  Description of Artificial Sequence: Synthetic peptide
GFTFSKAWMS

SEQ ID NO: 260 - protein, 10 aa, Artificial Sequence
  Description of Artificial Sequence: Synthetic peptide
GFTFSKAWMS

SEQ ID NO: 261 - protein, 10 aa, Artificial Sequence
  Description of Artificial Sequence: Synthetic peptide
GFTFSKAWMS

SEQ ID NO: 262 - protein, 10 aa, Artificial Sequence
  Description of Artificial Sequence: Synthetic peptide
GFTFSKAWMS

SEQ ID NO: 263 - protein, 10 aa, Artificial Sequence
  Description of Artificial Sequence: Synthetic peptide
GFTFSKAWMS

SEQ ID NO: 264 - protein, 10 aa, Artificial Sequence
  Description of Artificial Sequence: Synthetic peptide
GFTFSKAWMS

SEQ ID NO: 265 - protein, 10 aa, Artificial Sequence
  Description of Artificial Sequence: Synthetic peptide
GFTFSKAWMS

SEQ ID NO: 266 - protein, 10 aa, Artificial Sequence
  Description of Artificial Sequence: Synthetic peptide
GFTFSKAWMS

SEQ ID NO: 267 - protein, 10 aa, Artificial Sequence
  Description of Artificial Sequence: Synthetic peptide
GFTFSKAWMS

SEQ ID NO: 268 - protein, 10 aa, Artificial Sequence
  Description of Artificial Sequence: Synthetic peptide
GFTFSKAWMS

SEQ ID NO: 269 - protein, 10 aa, Artificial Sequence
  Description of Artificial Sequence: Synthetic peptide
GFTFSKAWMS

SEQ ID NO: 270 - protein, 10 aa, Artificial Sequence
  Description of Artificial Sequence: Synthetic peptide
GFTFSKAWMS

SEQ ID NO: 271 - protein, 10 aa, Artificial Sequence
  Description of Artificial Sequence: Synthetic peptide
GFTFSKAWMS

SEQ ID NO: 272 - protein, 10 aa, Artificial Sequence
  Description of Artificial Sequence: Synthetic peptide
GFTFSKAWMS

SEQ ID NO: 273 - protein, 10 aa, Artificial Sequence
  Description of Artificial Sequence: Synthetic peptide
GFTFSKAWMS

SEQ ID NO: 274 - protein, 10 aa, Artificial Sequence
  Description of Artificial Sequence: Synthetic peptide
GFTFSKAWMS

SEQ ID NO: 275 - protein, 10 aa, Artificial Sequence
  Description of Artificial Sequence: Synthetic peptide
GFTFSKAWMS

SEQ ID NO: 276 - protein, 10 aa, Artificial Sequence
  Description of Artificial Sequence: Synthetic peptide
GFTFSKAWMS

SEQ ID NO: 277 - protein, 10 aa, Artificial Sequence
  Description of Artificial Sequence: Synthetic peptide
GFTFSKAWMS

SEQ ID NO: 278 - protein, 10 aa, Artificial Sequence
  Description of Artificial Sequence: Synthetic peptide
GFTFSKAWMS

SEQ ID NO: 279 - protein, 10 aa, Artificial Sequence
  Description of Artificial Sequence: Synthetic peptide
GFTFSKAWMS

SEQ ID NO: 280 - protein, 10 aa, Artificial Sequence
  Description of Artificial Sequence: Synthetic peptide
GFTFSKAWMS

SEQ ID NO: 281 - protein, 10 aa, Artificial Sequence
  Description of Artificial Sequence: Synthetic peptide
GFTFSKAWMS

SEQ ID NO: 282 - protein, 10 aa, Artificial Sequence
  Description of Artificial Sequence: Synthetic peptide
GFTFSKAWMS

SEQ ID NO: 283 - protein, 10 aa, Artificial Sequence
  Description of Artificial Sequence: Synthetic peptide
GFTFSKAWMS

SEQ ID NO: 284 - protein, 10 aa, Artificial Sequence
  Description of Artificial Sequence: Synthetic peptide
GFTFSKAWMS

SEQ ID NO: 285 - protein, 10 aa, Artificial Sequence
  Description of Artificial Sequence: Synthetic peptide
GFTFSKAWMS

SEQ ID NO: 286 - protein, 10 aa, Artificial Sequence
  Description of Artificial Sequence: Synthetic peptide
GFTFSKAWMS

SEQ ID NO: 287 - protein, 10 aa, Artificial Sequence
  Description of Artificial Sequence: Synthetic peptide
GFTFSKAWMS

SEQ ID NO: 288 - protein, 10 aa, Artificial Sequence
  Description of Artificial Sequence: Synthetic peptide
GFTFSKAWMS

SEQ ID NO: 289 - protein, 10 aa, Artificial Sequence
  Description of Artificial Sequence: Synthetic peptide
GFTFSKAWMS

SEQ ID NO: 290 - protein, 10 aa, Artificial Sequence
  Description of Artificial Sequence: Synthetic peptide
GFTFSKAWMS

SEQ ID NO: 291 - protein, 10 aa, Artificial Sequence
  Description of Artificial Sequence: Synthetic peptide
GFTFSKAWMS

SEQ ID NO: 292 - protein, 10 aa, Artificial Sequence
  Description of Artificial Sequence: Synthetic peptide
GFTFSKAWMS

SEQ ID NO: 293 - protein, 10 aa, Artificial Sequence
  Description of Artificial Sequence: Synthetic peptide
GFTFSKAWMS

SEQ ID NO: 294 - protein, 10 aa, Artificial Sequence
  Description of Artificial Sequence: Synthetic peptide
GFTFSKAWMS

SEQ ID NO: 295 - protein, 10 aa, Artificial Sequence
  Description of Artificial Sequence: Synthetic peptide
GFTFSKAWMS

SEQ ID NO: 296 - protein, 10 aa, Artificial Sequence
  Description of Artificial Sequence: Synthetic peptide
GFTFSKAWMS

SEQ ID NO: 297 - protein, 10 aa, Artificial Sequence
  Description of Artificial Sequence: Synthetic peptide
GFTFSKAWMS

SEQ ID NO: 298 - protein, 10 aa, Artificial Sequence
  Description of Artificial Sequence: Synthetic peptide
GFTFSKAWMS

SEQ ID NO: 299 - protein, 10 aa, Artificial Sequence
  Description of Artificial Sequence: Synthetic peptide
GFTFSKAWMS

SEQ ID NO: 300 - protein, 10 aa, Artificial Sequence
  Description of Artificial Sequence: Synthetic peptide
GFTFSKAWMS

SEQ ID NO: 301 - protein, 10 aa, Artificial Sequence
  Description of Artificial Sequence: Synthetic peptide
GFTFSKAWMS

SEQ ID NO: 302 - protein, 10 aa, Artificial Sequence
  Description of Artificial Sequence: Synthetic peptide
GFTFSKAWMS

SEQ ID NO: 303 - protein, 10 aa, Artificial Sequence
  Description of Artificial Sequence: Synthetic peptide
GFTFSKAWMS

SEQ ID NO: 304 - protein, 10 aa, Artificial Sequence
  Description of Artificial Sequence: Synthetic peptide
GFTFSKAWMS

SEQ ID NO: 305 - protein, 10 aa, Artificial Sequence
  Description of Artificial Sequence: Synthetic peptide
GFTFSKAWMS

SEQ ID NO: 306 - protein, 10 aa, Artificial Sequence
  Description of Artificial Sequence: Synthetic peptide
GFTFSKAWMS

SEQ ID NO: 307 - protein, 10 aa, Artificial Sequence
  Description of Artificial Sequence: Synthetic peptide
GFTFSKAWMS

SEQ ID NO: 308 - protein, 10 aa, Artificial Sequence
  Description of Artificial Sequence: Synthetic peptide
GFTFSKAWMS

SEQ ID NO: 309 - protein, 10 aa, Artificial Sequence
  Description of Artificial Sequence: Synthetic peptide
GFTFSKAWYS

SEQ ID NO: 310 - protein, 10 aa, Artificial Sequence
  Description of Artificial Sequence: Synthetic peptide
GFTFSKAWMS

SEQ ID NO: 311 - protein, 10 aa, Artificial Sequence
  Description of Artificial Sequence: Synthetic peptide
GFTFSKAWMS

SEQ ID NO: 312 - protein, 10 aa, Artificial Sequence
  Description of Artificial Sequence: Synthetic peptide
GFTFSKAWMS

SEQ ID NO: 313 - protein, 10 aa, Artificial Sequence
  Description of Artificial Sequence: Synthetic peptide
GFTFSKAWMS

SEQ ID NO: 314 - protein, 10 aa, Artificial Sequence
  Description of Artificial Sequence: Synthetic peptide
GFTFSKAWMS

SEQ ID NO: 315 - protein, 10 aa, Artificial Sequence
  Description of Artificial Sequence: Synthetic peptide
GFTFSKAWMS

SEQ ID NO: 316 - protein, 10 aa, Artificial Sequence
  Description of Artificial Sequence: Synthetic peptide
GFTFSKAWMS

SEQ ID NO: 317 - protein, 10 aa, Artificial Sequence
  Description of Artificial Sequence: Synthetic peptide
GFTFSKAWMS

SEQ ID NO: 318 - protein, 10 aa, Artificial Sequence
  Description of Artificial Sequence: Synthetic peptide
GFTFSKAWMS

SEQ ID NO: 319 - protein, 10 aa, Artificial Sequence
  Description of Artificial Sequence: Synthetic peptide
GFTFSKAWMS

SEQ ID NO: 320 - protein, 10 aa, Artificial Sequence
  Description of Artificial Sequence: Synthetic peptide
GFTFSKAWMS

SEQ ID NO: 321 - protein, 10 aa, Artificial Sequence
  Description of Artificial Sequence: Synthetic peptide
GFTFSKAWMS

SEQ ID NO: 322 - protein, 10 aa, Artificial Sequence
  Description of Artificial Sequence: Synthetic peptide
GFTFSKAWMS

SEQ ID NO: 323 - protein, 10 aa, Artificial Sequence
  Description of Artificial Sequence: Synthetic peptide
GFTFSKAWMS

SEQ ID NO: 324 - protein, 10 aa, Artificial Sequence
  Description of Artificial Sequence: Synthetic peptide
GFTFSKAWMS

SEQ ID NO: 325 - protein, 10 aa, Artificial Sequence
  Description of Artificial Sequence: Synthetic peptide
GFTFSKAWMS

SEQ ID NO: 326 - protein, 10 aa, Artificial Sequence
  Description of Artificial Sequence: Synthetic peptide
GFTFSKAWMS

SEQ ID NO: 327 - protein, 10 aa, Artificial Sequence
  Description of Artificial Sequence: Synthetic peptide
GFTFSKAWMS

SEQ ID NO: 328 - protein, 10 aa, Artificial Sequence
  Description of Artificial Sequence: Synthetic peptide
GFTFSKAWMS

SEQ ID NO: 329 - protein, 10 aa, Artificial Sequence
  Description of Artificial Sequence: Synthetic peptide
GFTFSKAWMS

SEQ ID NO: 330 - protein, 10 aa, Artificial Sequence
  Description of Artificial Sequence: Synthetic peptide
GFTFSKAWMS

SEQ ID NO: 331 - protein, 10 aa, Artificial Sequence
  Description of Artificial Sequence: Synthetic peptide
GFTFSKAWMS

SEQ ID NO: 332 - protein, 10 aa, Artificial Sequence
  Description of Artificial Sequence: Synthetic peptide
GFTFSKAWMS

SEQ ID NO: 333 - protein, 10 aa, Artificial Sequence
  Description of Artificial Sequence: Synthetic peptide
GFTFSKAWMS

SEQ ID NO: 334 - protein, 10 aa, Artificial Sequence
  Description of Artificial Sequence: Synthetic peptide
GFTFSKAWMS

SEQ ID NO: 335 - protein, 10 aa, Artificial Sequence
  Description of Artificial Sequence: Synthetic peptide
GFTFSKAWMS

SEQ ID NO: 336 - protein, 10 aa, Artificial Sequence
  Description of Artificial Sequence: Synthetic peptide
GFTFSKAWMS

SEQ ID NO: 337 - protein, 10 aa, Artificial Sequence
  Description of Artificial Sequence: Synthetic peptide
GFTFSKAWMS

SEQ ID NO: 338 - protein, 10 aa, Artificial Sequence
  Description of Artificial Sequence: Synthetic peptide
GFTFSKAWMS

SEQ ID NO: 339 - protein, 10 aa, Artificial Sequence
  Description of Artificial Sequence: Synthetic peptide
GFTFSKAWMS

SEQ ID NO: 340 - protein, 10 aa, Artificial Sequence
  Description of Artificial Sequence: Synthetic peptide
GFTFSKAWMS

SEQ ID NO: 341 - protein, 10 aa, Artificial Sequence
  Description of Artificial Sequence: Synthetic peptide
GFTFSKAWMS

SEQ ID NO: 342 - protein, 10 aa, Artificial Sequence
  Description of Artificial Sequence: Synthetic peptide
GFTFSKAWMS

SEQ ID NO: 343 - protein, 10 aa, Artificial Sequence
  Description of Artificial Sequence: Synthetic peptide
GFTFSKAWMS

SEQ ID NO: 344 - protein, 10 aa, Artificial Sequence
  Description of Artificial Sequence: Synthetic peptide
GFTFSKAWMS

SEQ ID NO: 345 - protein, 10 aa, Artificial Sequence
  Description of Artificial Sequence: Synthetic peptide
GFTFSKAWMS

SEQ ID NO: 346 - protein, 10 aa, Artificial Sequence
  Description of Artificial Sequence: Synthetic peptide
GFTFAKAWMS

SEQ ID NO: 347 - protein, 10 aa, Artificial Sequence
  Description of Artificial Sequence: Synthetic peptide
GFTYAKAWMS

SEQ ID NO: 348 - protein, 10 aa, Artificial Sequence
  Description of Artificial Sequence: Synthetic peptide
GFDASKAWFT

SEQ ID NO: 349 - protein, 10 aa, Artificial Sequence
  Description of Artificial Sequence: Synthetic peptide
GFDASKAWFT

SEQ ID NO: 350 - protein, 10 aa, Artificial Sequence
  Description of Artificial Sequence: Synthetic peptide
GFDASKAWFT

SEQ ID NO: 351 - protein, 10 aa, Artificial Sequence
  Description of Artificial Sequence: Synthetic peptide
GFDASKAWFT

SEQ ID NO: 352 - protein, 10 aa, Artificial Sequence
  Description of Artificial Sequence: Synthetic peptide
GFTFSKAWMS

SEQ ID NO: 353 - protein, 10 aa, Artificial Sequence
  Description of Artificial Sequence: Synthetic peptide
GFTFSKAWMS

SEQ ID NO: 354 - protein, 10 aa, Artificial Sequence
  Description of Artificial Sequence: Synthetic peptide
GFTFSKAWMS

SEQ ID NO: 355 - protein, 10 aa, Artificial Sequence
  Description of Artificial Sequence: Synthetic peptide
GFTFSKAWMS

SEQ ID NO: 356 - protein, 10 aa, Artificial Sequence
  Description of Artificial Sequence: Synthetic peptide
GFTFSKAWMS

SEQ ID NO: 357 - protein, 10 aa, Artificial Sequence
  Description of Artificial Sequence: Synthetic peptide
GFTFSKAWMS

SEQ ID NO: 358 - protein, 10 aa, Artificial Sequence
  Description of Artificial Sequence: Synthetic peptide
GFVYSKAWMS

SEQ ID NO: 359 - protein, 10 aa, Artificial Sequence
  Description of Artificial Sequence: Synthetic peptide
GFVFSKAWMS

SEQ ID NO: 360 - protein, 10 aa, Artificial Sequence
  Description of Artificial Sequence: Synthetic peptide
GFTFAKAWMS

SEQ ID NO: 361 - protein, 10 aa, Artificial Sequence
  Description of Artificial Sequence: Synthetic peptide
GFTYAKAWFT

SEQ ID NO: 362 - protein, 10 aa, Artificial Sequence
  Description of Artificial Sequence: Synthetic peptide
GFTFSKAWMS

SEQ ID NO: 363 - protein, 19 aa, Artificial Sequence
  Description of Artificial Sequence: Synthetic peptide
RIKSVTEGETTDYAAPVKG

SEQ ID NO: 364 - protein, 19 aa, Artificial Sequence
  Description of Artificial Sequence: Synthetic peptide
RIKSVTEGETTDYAAPVKG

SEQ ID NO: 365 - protein, 19 aa, Artificial Sequence
  Description of Artificial Sequence: Synthetic peptide
RIKSVTDGETTDYAAPVKG

SEQ ID NO: 366 - protein, 19 aa, Artificial Sequence
  Description of Artificial Sequence: Synthetic peptide
RIKSVTDGETTDYAAPVKG

SEQ ID NO: 367 - protein, 19 aa, Artificial Sequence
  Description of Artificial Sequence: Synthetic peptide
RIKSVTDGETTDYAAPVKG

SEQ ID NO: 368 - protein, 19 aa, Artificial Sequence
  Description of Artificial Sequence: Synthetic peptide
RIKSVTDGETTDYAAPVKG

SEQ ID NO: 369 - protein, 19 aa, Artificial Sequence
  Description of Artificial Sequence: Synthetic peptide
RIKSVTDGETTDYAAPVKG

SEQ ID NO: 370 - protein, 19 aa, Artificial Sequence
  Description of Artificial Sequence: Synthetic peptide
RIKSVTDGETTDYAAPVKG

SEQ ID NO: 371 - protein, 19 aa, Artificial Sequence
  Description of Artificial Sequence: Synthetic peptide
RIKSVTDGETTDYAAPVKG

SEQ ID NO: 372 - protein, 19 aa, Artificial Sequence
  Description of Artificial Sequence: Synthetic peptide
RIKSVTDGETTDYAAPVKG

SEQ ID NO: 373 - protein, 19 aa, Artificial Sequence
  Description of Artificial Sequence: Synthetic peptide
RIKSVTDGETTDYAAPVKG

SEQ ID NO: 374 - protein, 19 aa, Artificial Sequence
  Description of Artificial Sequence: Synthetic peptide
RIKSVTDGETTDYAAPVKG

SEQ ID NO: 375 - protein, 19 aa, Artificial Sequence
  Description of Artificial Sequence: Synthetic peptide
RIKSVTDGETTDYAAPVKG

SEQ ID NO: 376 - protein, 19 aa, Artificial Sequence
  Description of Artificial Sequence: Synthetic peptide
RIKSVTDGETTDYAAPVKG

SEQ ID NO: 377 - protein, 19 aa, Artificial Sequence
  Description of Artificial Sequence: Synthetic peptide
RIKSVTDGETTDYAAPVKG

SEQ ID NO: 378 - protein, 19 aa, Artificial Sequence
  Description of Artificial Sequence: Synthetic peptide
RIKSVTDGETTDYAAPVKG

SEQ ID NO: 379 - protein, 19 aa, Artificial Sequence
  Description of Artificial Sequence: Synthetic peptide
RIKSVTDGETTDYAAPVKG

SEQ ID NO: 380 - protein, 19 aa, Artificial Sequence
  Description of Artificial Sequence: Synthetic peptide
RIQSVTDGETTDYAAPVKG

SEQ ID NO: 381 - protein, 19 aa, Artificial Sequence
  Description of Artificial Sequence: Synthetic peptide
RIKAVTDGETTDYAAPVKG

SEQ ID NO: 382 - protein, 19 aa, Artificial Sequence
  Description of Artificial Sequence: Synthetic peptide
RIKSATDGETTDYAAPVKG

SEQ ID NO: 383 - protein, 19 aa, Artificial Sequence
  Description of Artificial Sequence: Synthetic peptide
RIKSNTDGETTDYAAPVKG

SEQ ID NO: 384 - protein, 19 aa, Artificial Sequence
  Description of Artificial Sequence: Synthetic peptide
RIKSVHDGETTDYAAPVKG

SEQ ID NO: 385 - protein, 19 aa, Artificial Sequence
  Description of Artificial Sequence: Synthetic peptide
RIKSVDDGETTDYAAPVKG

SEQ ID NO: 386 - protein, 19 aa, Artificial Sequence
  Description of Artificial Sequence: Synthetic peptide
RIKSVQDGETTDYAAPVKG

SEQ ID NO: 387 - protein, 19 aa, Artificial Sequence
  Description of Artificial Sequence: Synthetic peptide
RIKSVTNGETTDYAAPVKG

SEQ ID NO: 388 - protein, 19 aa, Artificial Sequence
  Description of Artificial Sequence: Synthetic peptide
RIKSVTDAETTDYAAPVKG

SEQ ID NO: 389 - protein, 19 aa, Artificial Sequence
  Description of Artificial Sequence: Synthetic peptide
RIKSVTDGQTTDYAAPVKG

SEQ ID NO: 390 - protein, 19 aa, Artificial Sequence
  Description of Artificial Sequence: Synthetic peptide
RIKSVTDGHTTDYAAPVKG

SEQ ID NO: 391 - protein, 19 aa, Artificial Sequence
  Description of Artificial Sequence: Synthetic peptide
RIKSVTDGEQTDYAAPVKG

SEQ ID NO: 392 - protein, 19 aa, Artificial Sequence
  Description of Artificial Sequence: Synthetic peptide
RIKSVTDGEATDYAAPVKG

SEQ ID NO: 393 - protein, 19 aa, Artificial Sequence
  Description of Artificial Sequence: Synthetic peptide
RIKSVTDGETTDYASPVKG

SEQ ID NO: 394 - protein, 19 aa, Artificial Sequence
  Description of Artificial Sequence: Synthetic peptide
RIKSVTDGETTDYAAPVQG

SEQ ID NO: 395 - protein, 19 aa, Artificial Sequence
  Description of Artificial Sequence: Synthetic peptide
RIKSVTDGETTDYAAPVKG

SEQ ID NO: 396 - protein, 19 aa, Artificial Sequence
  Description of Artificial Sequence: Synthetic peptide
RIKSVTDGETTDYAAPVKG

SEQ ID NO: 397 - protein, 19 aa, Artificial Sequence
  Description of Artificial Sequence: Synthetic peptide
RIKSVTDGETTDYAAPVKG

SEQ ID NO: 398 - protein, 19 aa, Artificial Sequence
  Description of Artificial Sequence: Synthetic peptide
RIKSVTDGETTDYAAPVKG

SEQ ID NO: 399 - protein, 19 aa, Artificial Sequence
  Description of Artificial Sequence: Synthetic peptide
RIKSVTDGETTDYAAPVKG

SEQ ID NO: 400 - protein, 19 aa, Artificial Sequence
  Description of Artificial Sequence: Synthetic peptide
RIKSVTDGETTDYAAPVKG

SEQ ID NO: 401 - protein, 19 aa, Artificial Sequence
  Description of Artificial Sequence: Synthetic peptide
RIKSVTDGETTDYAAPVKG

SEQ ID NO: 402 - protein, 19 aa, Artificial Sequence
  Description of Artificial Sequence: Synthetic peptide
RIKSVTDGETTDYAAPVKG

SEQ ID NO: 403 - protein, 19 aa, Artificial Sequence
  Description of Artificial Sequence: Synthetic peptide
RIKSVTDGETTDYAAPVKG

SEQ ID NO: 404 - protein, 19 aa, Artificial Sequence
  Description of Artificial Sequence: Synthetic peptide
RIKSVTDGETTDYAAPVKG

SEQ ID NO: 405 - protein, 19 aa, Artificial Sequence
  Description of Artificial Sequence: Synthetic peptide
RIKSVTDGETTDYAAPVKG

SEQ ID NO: 406 - protein, 19 aa, Artificial Sequence
  Description of Artificial Sequence: Synthetic peptide
RIKSVTDGETTDYAAPVKG

SEQ ID NO: 407 - protein, 19 aa, Artificial Sequence
  Description of Artificial Sequence: Synthetic peptide
RIKSVTDGETTDYAAPVKG

SEQ ID NO: 408 - protein, 19 aa, Artificial Sequence
  Description of Artificial Sequence: Synthetic peptide
RIKSVTDGETTDYAAPVKG

SEQ ID NO: 409 - protein, 19 aa, Artificial Sequence
  Description of Artificial Sequence: Synthetic peptide
RIKSVTDGETTDYAAPVKG

SEQ ID NO: 410 - protein, 19 aa, Artificial Sequence
  Description of Artificial Sequence: Synthetic peptide
RIKSVTDGETTDYAAPVKG

SEQ ID NO: 411 - protein, 19 aa, Artificial Sequence
  Description of Artificial Sequence: Synthetic peptide
RIKSVTDGETTDYAAPVKG

SEQ ID NO: 412 - protein, 19 aa, Artificial Sequence
  Description of Artificial Sequence: Synthetic peptide
RIKSVTDGETTDYAAPVKG

SEQ ID NO: 413 - protein, 19 aa, Artificial Sequence
  Description of Artificial Sequence: Synthetic peptide
RIKSVTDGETTDYAAPVKG

SEQ ID NO: 414 - protein, 19 aa, Artificial Sequence
  Description of Artificial Sequence: Synthetic peptide
RIKSVTDGETTDYAAPVKG

SEQ ID NO: 415 - protein, 19 aa, Artificial Sequence
  Description of Artificial Sequence: Synthetic peptide
RIKSVTDGETTDYAAPVKG

SEQ ID NO: 416 - protein, 19 aa, Artificial Sequence
  Description of Artificial Sequence: Synthetic peptide
RIKSVTDGETTDYAAPVKG

SEQ ID NO: 417 - protein, 19 aa, Artificial Sequence
  Description of Artificial Sequence: Synthetic peptide
RIKSVTDGETTDYAAPVKG

SEQ ID NO: 418 - protein, 19 aa, Artificial Sequence
  Description of Artificial Sequence: Synthetic peptide
RIKSVTDGETTDYAAPVKG

SEQ ID NO: 419 - protein, 19 aa, Artificial Sequence
  Description of Artificial Sequence: Synthetic peptide
RIKSVTDGETTDYAAPVKG

SEQ ID NO: 420 - protein, 19 aa, Artificial Sequence
  Description of Artificial Sequence: Synthetic peptide
RIKSVTDGETTDYAAPVKG

SEQ ID NO: 421 - protein, 19 aa, Artificial Sequence
  Description of Artificial Sequence: Synthetic peptide
RIKSVTDGETTDYAAPVKG

SEQ ID NO: 422 - protein, 19 aa, Artificial Sequence
  Description of Artificial Sequence: Synthetic peptide
RIKSVTDGETTDYAAPVKG

SEQ ID NO: 423 - protein, 19 aa, Artificial Sequence
  Description of Artificial Sequence: Synthetic peptide
RIKSVTDGETTDYAAPVKG

SEQ ID NO: 424 - protein, 19 aa, Artificial Sequence
  Description of Artificial Sequence: Synthetic peptide
RIKSVTDGETTDYAAPVKG

SEQ ID NO: 425 - protein, 19 aa, Artificial Sequence
  Description of Artificial Sequence: Synthetic peptide
RIKSVTDGETTDYAAPVKG

SEQ ID NO: 426 - protein, 19 aa, Artificial Sequence
  Description of Artificial Sequence: Synthetic peptide
RIKSVTDGETTDYAAPVKG

SEQ ID NO: 427 - protein, 19 aa, Artificial Sequence
  Description of Artificial Sequence: Synthetic peptide
RIKSVTDGETTDYAAPVKG

SEQ ID NO: 428 - protein, 19 aa, Artificial Sequence
  Description of Artificial Sequence: Synthetic peptide
RIKSVTDGETTDYAAPVKG

SEQ ID NO: 429 - protein, 19 aa, Artificial Sequence
  Description of Artificial Sequence: Synthetic peptide
RIKSVTDGETTDYAAPVKG

SEQ ID NO: 430 - protein, 19 aa, Artificial Sequence
  Description of Artificial Sequence: Synthetic peptide
RIKSVTDGETTDYAAPVKG

SEQ ID NO: 431 - protein, 19 aa, Artificial Sequence
  Description of Artificial Sequence: Synthetic peptide
RIKSVTDGETTDYAAPVKG

SEQ ID NO: 432 - protein, 19 aa, Artificial Sequence
  Description of Artificial Sequence: Synthetic peptide
RIKSVTDGETTDYAAPVKG

SEQ ID NO: 433 - protein, 19 aa, Artificial Sequence
  Description of Artificial Sequence: Synthetic peptide
RIKSVTDGETTDYAAPVKG

SEQ ID NO: 434 - protein, 19 aa, Artificial Sequence
  Description of Artificial Sequence: Synthetic peptide
RIKSVTDGETTDYAAPVKG

SEQ ID NO: 435 - protein, 19 aa, Artificial Sequence
  Description of Artificial Sequence: Synthetic peptide
RIKSVTDGETTDYAAPVKG

SEQ ID NO: 436 - protein, 19 aa, Artificial Sequence
  Description of Artificial Sequence: Synthetic peptide
RIKSVTDGETTDYAAPVKG

SEQ ID NO: 437 - protein, 19 aa, Artificial Sequence
  Description of Artificial Sequence: Synthetic peptide
RIKSVTDGETTDYAAPVKG

SEQ ID NO: 438 - protein, 19 aa, Artificial Sequence
  Description of Artificial Sequence: Synthetic peptide
RIKSVTDGETTDYAAPVKG

SEQ ID NO: 439 - protein, 19 aa, Artificial Sequence
  Description of Artificial Sequence: Synthetic peptide
RIKSVTDGETTDYAAPVKG

SEQ ID NO: 440 - protein, 19 aa, Artificial Sequence
  Description of Artificial Sequence: Synthetic peptide
RIKSVTDGETTDYAAPVKG

SEQ ID NO: 441 - protein, 19 aa, Artificial Sequence
  Description of Artificial Sequence: Synthetic peptide
RIKSVTDGETTDYAAPVKG

SEQ ID NO: 442 - protein, 19 aa, Artificial Sequence
  Description of Artificial Sequence: Synthetic peptide
RIKSVTDGETTDYAAPVKG

SEQ ID NO: 443 - protein, 19 aa, Artificial Sequence
  Description of Artificial Sequence: Synthetic peptide
RIKSVTDGETTDYAAPVKG

SEQ ID NO: 444 - protein, 19 aa, Artificial Sequence
  Description of Artificial Sequence: Synthetic peptide
RIKSVTDGETTDYAAPVKG

SEQ ID NO: 445 - protein, 19 aa, Artificial Sequence
  Description of Artificial Sequence: Synthetic peptide
RIKSVTDGETTDYAAPVKG

SEQ ID NO: 446 - protein, 19 aa, Artificial Sequence
  Description of Artificial Sequence: Synthetic peptide
RIKSVTDGETTDYAAPVKG

SEQ ID NO: 447 - protein, 19 aa, Artificial Sequence
  Description of Artificial Sequence: Synthetic peptide
RIKSVTDGETTDYAAPVKG

SEQ ID NO: 448 - protein, 19 aa, Artificial Sequence
  Description of Artificial Sequence: Synthetic peptide
RIKSVTDGETTDYAAPVKG

SEQ ID NO: 449 - protein, 19 aa, Artificial Sequence
  Description of Artificial Sequence: Synthetic peptide
RIKSVTDGQTTDYAAPVKG

SEQ ID NO: 450 - protein, 19 aa, Artificial Sequence
  Description of Artificial Sequence: Synthetic peptide
RIKSVTDGETTDYAAPVKG

SEQ ID NO: 451 - protein, 19 aa, Artificial Sequence
  Description of Artificial Sequence: Synthetic peptide
RIKSVTDGETTDYAAPVKG

SEQ ID NO: 452 - protein, 19 aa, Artificial Sequence
  Description of Artificial Sequence: Synthetic peptide
RIKSVTDGETTDYAAPVKG

SEQ ID NO: 453 - protein, 19 aa, Artificial Sequence
  Description of Artificial Sequence: Synthetic peptide
RIKSVTDGETTDYAAPVKG

SEQ ID NO: 454 - protein, 19 aa, Artificial Sequence
  Description of Artificial Sequence: Synthetic peptide
RIKSVTDGETTDYAAPVKG

SEQ ID NO: 455 - protein, 19 aa, Artificial Sequence
  Description of Artificial Sequence: Synthetic peptide
RIKSVTDGETTDYAAPVKG

SEQ ID NO: 456 - protein, 19 aa, Artificial Sequence
  Description of Artificial Sequence: Synthetic peptide
RIKSVTDGETTDYAAPVKG

SEQ ID NO: 457 - protein, 19 aa, Artificial Sequence
  Description of Artificial Sequence: Synthetic peptide
RIKSVTDGETTDYAAPVKG

SEQ ID NO: 458 - protein, 19 aa, Artificial Sequence
  Description of Artificial Sequence: Synthetic peptide
RIKSVTDGETTDYAAPVKG

SEQ ID NO: 459 - protein, 19 aa, Artificial Sequence
  Description of Artificial Sequence: Synthetic peptide
RIKSVTDGETTDYAAPVKG

SEQ ID NO: 460 - protein, 19 aa, Artificial Sequence
  Description of Artificial Sequence: Synthetic peptide
RIKSVTDGETTDYAAPVKG

SEQ ID NO: 461 - protein, 19 aa, Artificial Sequence
  Description of Artificial Sequence: Synthetic peptide
RIKSVTDGETTDYAAPVKG

SEQ ID NO: 462 - protein, 19 aa, Artificial Sequence
  Description of Artificial Sequence: Synthetic peptide
RIKSVTDGETTDYAAPVKG

SEQ ID NO: 463 - protein, 19 aa, Artificial Sequence
  Description of Artificial Sequence: Synthetic peptide
RIKSVTDGETTDYAAPVKG

SEQ ID NO: 464 - protein, 19 aa, Artificial Sequence
  Description of Artificial Sequence: Synthetic peptide
RIKSVTDGETTDYAAPVKG

SEQ ID NO: 465 - protein, 19 aa, Artificial Sequence
  Description of Artificial Sequence: Synthetic peptide
RIKSVTDGETTDYAAPVKG

SEQ ID NO: 466 - protein, 19 aa, Artificial Sequence
  Description of Artificial Sequence: Synthetic peptide
RIKSVTDGETTDYAAPVKG

SEQ ID NO: 467 - protein, 19 aa, Artificial Sequence
  Description of Artificial Sequence: Synthetic peptide
RIKSVTDGETTDYAAPVKG

SEQ ID NO: 468 - protein, 19 aa, Artificial Sequence
  Description of Artificial Sequence: Synthetic peptide
RIKSVTDGETTDYAAPVKG

SEQ ID NO: 469 - protein, 19 aa, Artificial Sequence
  Description of Artificial Sequence: Synthetic peptide
RIKSVTDGETTDYAAPVKG

SEQ ID NO: 470 - protein, 19 aa, Artificial Sequence
  Description of Artificial Sequence: Synthetic peptide
RIKSVTDGETTDYAAPVKG

SEQ ID NO: 471 - protein, 19 aa, Artificial Sequence
  Description of Artificial Sequence: Synthetic peptide
RIKSVTDGETTDYAAPVKG

SEQ ID NO: 472 - protein, 19 aa, Artificial Sequence
  Description of Artificial Sequence: Synthetic peptide
RIKSVTDGETTDYAAPVKG

SEQ ID NO: 473 - protein, 19 aa, Artificial Sequence
  Description of Artificial Sequence: Synthetic peptide
RIKSVTDGETTDYAAPVKG

SEQ ID NO: 474 - protein, 19 aa, Artificial Sequence
  Description of Artificial Sequence: Synthetic peptide
RIKSVTDGETTDYAAPVKG

SEQ ID NO: 475 - protein, 19 aa, Artificial Sequence
  Description of Artificial Sequence: Synthetic peptide
RIKSVTDGETTDYAAPVKG

SEQ ID NO: 476 - protein, 19 aa, Artificial Sequence
  Description of Artificial Sequence: Synthetic peptide
RIKSVTDGETTDYAAPVKG

SEQ ID NO: 477 - protein, 19 aa, Artificial Sequence
  Description of Artificial Sequence: Synthetic peptide
RIKSVTDGETTDYAAPVKG

SEQ ID NO: 478 - protein, 19 aa, Artificial Sequence
  Description of Artificial Sequence: Synthetic peptide
RIKSVTDGETTDYAAPVKG

SEQ ID NO: 479 - protein, 19 aa, Artificial Sequence
  Description of Artificial Sequence: Synthetic peptide
RIKSVTDGETTDYAAPVKG

SEQ ID NO: 480 - protein, 19 aa, Artificial Sequence
  Description of Artificial Sequence: Synthetic peptide
RIKSVTDGETTDYAAPVKG

SEQ ID NO: 481 - protein, 19 aa, Artificial Sequence
  Description of Artificial Sequence: Synthetic peptide
RIKSVTDGETTDYAAPVKG

SEQ ID NO: 482 - protein, 19 aa, Artificial Sequence
  Description of Artificial Sequence: Synthetic peptide
RIKSVTDGETTDYAAPVKG

SEQ ID NO: 483 - protein, 19 aa, Artificial Sequence
  Description of Artificial Sequence: Synthetic peptide
RIKSVTDGETTDYAAPVKG

SEQ ID NO: 484 - protein, 19 aa, Artificial Sequence
  Description of Artificial Sequence: Synthetic peptide
RIKSVTDGETTDYAAPVKG

SEQ ID NO: 485 - protein, 19 aa, Artificial Sequence
  Description of Artificial Sequence: Synthetic peptide
RIKSVTDGETTDYAAPVKG

SEQ ID NO: 486 - protein, 19 aa, Artificial Sequence
  Description of Artificial Sequence: Synthetic peptide
RIKSVTDGETTDYAAPVKG

SEQ ID NO: 487 - protein, 19 aa, Artificial Sequence
  Description of Artificial Sequence: Synthetic peptide
RIKSVTDGETTDYAAPVKG

SEQ ID NO: 488 - protein, 19 aa, Artificial Sequence
  Description of Artificial Sequence: Synthetic peptide
RIKSVTDGETTDYAAPVKG

SEQ ID NO: 489 - protein, 19 aa, Artificial Sequence
  Description of Artificial Sequence: Synthetic peptide
RIKSVTDGETTDYAAPVKG

SEQ ID NO: 490 - protein, 19 aa, Artificial Sequence
  Description of Artificial Sequence: Synthetic peptide
RIKSVTDGETTDYAAPVKG

SEQ ID NO: 491 - protein, 19 aa, Artificial Sequence
  Description of Artificial Sequence: Synthetic peptide
RIKSVTDGETTDYAAPVKG

SEQ ID NO: 492 - protein, 19 aa, Artificial Sequence
  Description of Artificial Sequence: Synthetic peptide
RIKSVTDGETTDYAAPVKG

SEQ ID NO: 493 - protein, 19 aa, Artificial Sequence
  Description of Artificial Sequence: Synthetic peptide
RIKSVTDGETTDYAAPVKG

SEQ ID NO: 494 - protein, 19 aa, Artificial Sequence
  Description of Artificial Sequence: Synthetic peptide
RIKSVTDGETTDYAAPVKG

SEQ ID NO: 495 - protein, 19 aa, Artificial Sequence
  Description of Artificial Sequence: Synthetic peptide
RIKSVTDGETTDYAAPVKG

SEQ ID NO: 496 - protein, 19 aa, Artificial Sequence
  Description of Artificial Sequence: Synthetic peptide
RIKSVTDGETTDYAAPVKG

SEQ ID NO: 497 - protein, 19 aa, Artificial Sequence
  Description of Artificial Sequence: Synthetic peptide
RIKSVTDGETTDYAAPVKG

SEQ ID NO: 498 - protein, 19 aa, Artificial Sequence
  Description of Artificial Sequence: Synthetic peptide
RIKSVTDGETTDYAAPVKG

SEQ ID NO: 499 - protein, 19 aa, Artificial Sequence
  Description of Artificial Sequence: Synthetic peptide
RIKSVTDGETTDYAAPVKG

SEQ ID NO: 500 - protein, 19 aa, Artificial Sequence
  Description of Artificial Sequence: Synthetic peptide
RIKSVTDGETTDYAAPVKG

SEQ ID NO: 501 - protein, 19 aa, Artificial Sequence
  Description of Artificial Sequence: Synthetic peptide
RIKSVTDGETTDYAAPVKG

SEQ ID NO: 502 - protein, 19 aa, Artificial Sequence
  Description of Artificial Sequence: Synthetic peptide
RIKSVTDGETTDYAAPVKG

SEQ ID NO: 503 - protein, 19 aa, Artificial Sequence
  Description of Artificial Sequence: Synthetic peptide
RIKSVTDGETTDYAAPVKG

SEQ ID NO: 504 - protein, 19 aa, Artificial Sequence
  Description of Artificial Sequence: Synthetic peptide
RIKSVTDGETTEYAASVKG

SEQ ID NO: 505 - protein, 19 aa, Artificial Sequence
  Description of Artificial Sequence: Synthetic peptide
RIKSVTDGETTEYAASVKG

SEQ ID NO: 506 - protein, 19 aa, Artificial Sequence
  Description of Artificial Sequence: Synthetic peptide
FIKSVTDGETTEYAASVKG

SEQ ID NO: 507 - protein, 19 aa, Artificial Sequence
  Description of Artificial Sequence: Synthetic peptide
RIKSVTDGETTDYAAPVKG

SEQ ID NO: 508 - protein, 19 aa, Artificial Sequence
  Description of Artificial Sequence: Synthetic peptide
RIKSVTDGETTDYAAPVKG

SEQ ID NO: 509 - protein, 19 aa, Artificial Sequence
  Description of Artificial Sequence: Synthetic peptide
RIKSVTDGETTDYAAPVKG

SEQ ID NO: 510 - protein, 19 aa, Artificial Sequence
  Description of Artificial Sequence: Synthetic peptide
RIKSVTDGETTDYAAPVKG

SEQ ID NO: 511 - protein, 19 aa, Artificial Sequence
  Description of Artificial Sequence: Synthetic peptide
RIKSVTDGETTDYAAPVKG

SEQ ID NO: 512 - protein, 19 aa, Artificial Sequence
  Description of Artificial Sequence: Synthetic peptide
RIKSVTDGETTDYAAPVKG

SEQ ID NO: 513 - protein, 19 aa, Artificial Sequence
  Description of Artificial Sequence: Synthetic peptide
RIKSVTDGETTDYAAPVKG

SEQ ID NO: 514 - protein, 19 aa, Artificial Sequence
  Description of Artificial Sequence: Synthetic peptide
RIKSVTDGETTDYAAPVKG

SEQ ID NO: 515 - protein, 19 aa, Artificial Sequence
  Description of Artificial Sequence: Synthetic peptide
RIKSVTDGETTDYAAPVKG

SEQ ID NO: 516 - protein, 19 aa, Artificial Sequence
  Description of Artificial Sequence: Synthetic peptide
RIKSVTDGETTDYAAPVKG

SEQ ID NO: 517 - protein, 19 aa, Artificial Sequence
  Description of Artificial Sequence: Synthetic peptide
RIKSVTDGETTDYAAPVKG

SEQ ID NO: 518 - protein, 19 aa, Artificial Sequence
  Description of Artificial Sequence: Synthetic peptide
RIKSVTDGETTDYAAPVKG

SEQ ID NO: 519 - protein, 19 aa, Artificial Sequence
  Description of Artificial Sequence: Synthetic peptide
RIKSVTDGETTDYAAPVKG

SEQ ID NO: 520 - protein, 19 aa, Artificial Sequence
  Description of Artificial Sequence: Synthetic peptide
RIKSVTDGETTDYAAPVKG

SEQ ID NO: 521 - protein, 19 aa, Artificial Sequence
  Description of Artificial Sequence: Synthetic peptide
RIKSVTDGETTDYAAPVKG

SEQ ID NO: 522 - protein, 19 aa, Artificial Sequence
  Description of Artificial Sequence: Synthetic peptide
RIKSVTDGETTDYAAPVKG

SEQ ID NO: 523 - protein, 19 aa, Artificial Sequence
  Description of Artificial Sequence: Synthetic peptide
RIKSVTDGETTDYAAPVKG

SEQ ID NO: 524 - protein, 19 aa, Artificial Sequence
  Description of Artificial Sequence: Synthetic peptide
RIKSVTDGETTDYAAPVKG

SEQ ID NO: 525 - protein, 19 aa, Artificial Sequence
  Description of Artificial Sequence: Synthetic peptide
RIKSVTDGETTDYAAPVKG

SEQ ID NO: 526 - protein, 19 aa, Artificial Sequence
  Description of Artificial Sequence: Synthetic peptide
RIKSVTDGETTDYAAPVKG

SEQ ID NO: 527 - protein, 19 aa, Artificial Sequence
  Description of Artificial Sequence: Synthetic peptide
RIKSVTDGETTDYAAPVKG

SEQ ID NO: 528 - protein, 19 aa, Artificial Sequence
  Description of Artificial Sequence: Synthetic peptide
RIKSVTDGETTDYAAPVKG

SEQ ID NO: 529 - protein, 19 aa, Artificial Sequence
  Description of Artificial Sequence: Synthetic peptide
RIKSVTDGETTDYAAPVKG

SEQ ID NO: 530 - protein, 19 aa, Artificial Sequence
  Description of Artificial Sequence: Synthetic peptide
RIKSVTDGETTDYAAPVKG

SEQ ID NO: 531 - protein, 19 aa, Artificial Sequence
  Description of Artificial Sequence: Synthetic peptide
RIKSVTDGETTDYAAPVKG

SEQ ID NO: 532 - protein, 19 aa, Artificial Sequence
  Description of Artificial Sequence: Synthetic peptide
RIKSVTDGETTDYAAPVKG

SEQ ID NO: 533 - protein, 19 aa, Artificial Sequence
  Description of Artificial Sequence: Synthetic peptide
RIKSVTDGETTDYAAPVKG

SEQ ID NO: 534 - protein, 19 aa, Artificial Sequence
  Description of Artificial Sequence: Synthetic peptide
RIKSVTDGETTDYAAPVKG

SEQ ID NO: 535 - protein, 19 aa, Artificial Sequence
  Description of Artificial Sequence: Synthetic peptide
RIKSVTDGETTDYAAPVKG

SEQ ID NO: 536 - protein, 19 aa, Artificial Sequence
  Description of Artificial Sequence: Synthetic peptide
RIKSVTDGETTDYAAPVKG

SEQ ID NO: 537 - protein, 19 aa, Artificial Sequence
  Description of Artificial Sequence: Synthetic peptide
RIKSVTDGETTDYAAPVKG

SEQ ID NO: 538 - protein, 19 aa, Artificial Sequence
  Description of Artificial Sequence: Synthetic peptide
RIKSVTDGETTDYAAPVKG

SEQ ID NO: 539 - protein, 19 aa, Artificial Sequence
  Description of Artificial Sequence: Synthetic peptide
RIKSVTDGETTDYAAPVKG

SEQ ID NO: 540 - protein, 19 aa, Artificial Sequence
  Description of Artificial Sequence: Synthetic peptide
RIKAADDGKQTDYAAPVKG

SEQ ID NO: 541 - protein, 19 aa, Artificial Sequence
  Description of Artificial Sequence: Synthetic peptide
RIKSVQDGEQTDYAAPVKG

SEQ ID NO: 542 - protein, 19 aa, Artificial Sequence
  Description of Artificial Sequence: Synthetic peptide
RIKSVTDGETTDYAAPVKG

SEQ ID NO: 543 - protein, 19 aa, Artificial Sequence
  Description of Artificial Sequence: Synthetic peptide
RIKSVTDGETTDYAAPVKG

SEQ ID NO: 544 - protein, 19 aa, Artificial Sequence
  Description of Artificial Sequence: Synthetic peptide
RIKSVTDGETTDYAAPVKG

SEQ ID NO: 545 - protein, 19 aa, Artificial Sequence
  Description of Artificial Sequence: Synthetic peptide
RIKSVTDGETTDYAAPVKG

SEQ ID NO: 546 - protein, 19 aa, Artificial Sequence
  Description of Artificial Sequence: Synthetic peptide
RIKAADDGKQTDYAAPVKG

SEQ ID NO: 547 - protein, 19 aa, Artificial Sequence
  Description of Artificial Sequence: Synthetic peptide
RIKAADDGKQTDYAAPVKG

SEQ ID NO: 548 - protein, 19 aa, Artificial Sequence
  Description of Artificial Sequence: Synthetic peptide
RIKAADDGKQTDYAAPVKG

SEQ ID NO: 549 - protein, 19 aa, Artificial Sequence
  Description of Artificial Sequence: Synthetic peptide
RIKAADDGKQTDYAAPVKG

SEQ ID NO: 550 - protein, 19 aa, Artificial Sequence
  Description of Artificial Sequence: Synthetic peptide
RIKAADDGKQTDYAAPVKG

SEQ ID NO: 551 - protein, 19 aa, Artificial Sequence
  Description of Artificial Sequence: Synthetic peptide
RIKAVTDGHTTDYAAPVKG

SEQ ID NO: 552 - protein, 19 aa, Artificial Sequence
  Description of Artificial Sequence: Synthetic peptide
RIKSVTDGQATDYAAPVKG

SEQ ID NO: 553 - protein, 19 aa, Artificial Sequence
  Description of Artificial Sequence: Synthetic peptide
RIKSVTDGETTDYAAPVKG

SEQ ID NO: 554 - protein, 19 aa, Artificial Sequence
  Description of Artificial Sequence: Synthetic peptide
RIKSVTDAETTDYAAPVKG

SEQ ID NO: 555 - protein, 19 aa, Artificial Sequence
  Description of Artificial Sequence: Synthetic peptide
RIKSTSDGGITDYAAPVKG

SEQ ID NO: 556 - protein, 19 aa, Artificial Sequence
  Description of Artificial Sequence: Synthetic peptide
RIKSVSDGETTDYAAPVKG

SEQ ID NO: 557 - protein, 31 aa, Artificial Sequence; identical to SEQ ID NO: 34
  Description of Artificial Sequence: Synthetic polypeptide

SEQ ID NO: 558 - protein, 31 aa, Artificial Sequence; identical to SEQ ID NO: 34
  Description of Artificial Sequence: Synthetic polypeptide

SEQ ID NO: 559 - protein, 31 aa, Artificial Sequence; identical to SEQ ID NO: 41
  Description of Artificial Sequence: Synthetic polypeptide

SEQ ID NO: 560 - protein, 31 aa, Artificial Sequence; identical to SEQ ID NO: 21
  Description of Artificial Sequence: Synthetic polypeptide

SEQ ID NO: 561 - protein, 31 aa, Artificial Sequence; identical to SEQ ID NO: 21
  Description of Artificial Sequence: Synthetic polypeptide

SEQ ID NO: 562 - protein, 31 aa, Artificial Sequence; identical to SEQ ID NO: 21
  Description of Artificial Sequence: Synthetic polypeptide

SEQ ID NO: 563 - protein, 31 aa, Artificial Sequence; identical to SEQ ID NO: 21
  Description of Artificial Sequence: Synthetic polypeptide

SEQ ID NO: 564 - protein, 31 aa, Artificial Sequence; identical to SEQ ID NO: 21
  Description of Artificial Sequence: Synthetic polypeptide

SEQ ID NO: 565 - protein, 31 aa, Artificial Sequence; identical to SEQ ID NO: 21
  Description of Artificial Sequence: Synthetic polypeptide

SEQ ID NO: 566 - protein, 31 aa, Artificial Sequence; identical to SEQ ID NO: 21
  Description of Artificial Sequence: Synthetic polypeptide

SEQ ID NO: 567 - protein, 31 aa, Artificial Sequence; identical to SEQ ID NO: 21
  Description of Artificial Sequence: Synthetic polypeptide

SEQ ID NO: 568 - protein, 31 aa, Artificial Sequence; identical to SEQ ID NO: 21
  Description of Artificial Sequence: Synthetic polypeptide

SEQ ID NO: 569 - protein, 31 aa, Artificial Sequence; identical to SEQ ID NO: 21
  Description of Artificial Sequence: Synthetic polypeptide

SEQ ID NO: 570 - protein, 31 aa, Artificial Sequence; identical to SEQ ID NO: 21
  Description of Artificial Sequence: Synthetic polypeptide

SEQ ID NO: 571 - protein, 31 aa, Artificial Sequence; identical to SEQ ID NO: 21
  Description of Artificial Sequence: Synthetic polypeptide

SEQ ID NO: 572 - protein, 31 aa, Artificial Sequence; identical to SEQ ID NO: 21
  Description of Artificial Sequence: Synthetic polypeptide

SEQ ID NO: 573 - protein, 31 aa, Artificial Sequence; identical to SEQ ID NO: 21
  Description of Artificial Sequence: Synthetic polypeptide

SEQ ID NO: 574 - protein, 31 aa, Artificial Sequence; identical to SEQ ID NO: 21
  Description of Artificial Sequence: Synthetic polypeptide

SEQ ID NO: 575 - protein, 31 aa, Artificial Sequence; identical to SEQ ID NO: 21
  Description of Artificial Sequence: Synthetic polypeptide

SEQ ID NO: 576 - protein, 31 aa, Artificial Sequence; identical to SEQ ID NO: 21
  Description of Artificial Sequence: Synthetic polypeptide

SEQ ID NO: 577 - protein, 31 aa, Artificial Sequence; identical to SEQ ID NO: 21
  Description of Artificial Sequence: Synthetic polypeptide

SEQ ID NO: 578 - protein, 31 aa, Artificial Sequence; identical to SEQ ID NO: 21
  Description of Artificial Sequence: Synthetic polypeptide

SEQ ID NO: 579 - protein, 31 aa, Artificial Sequence; identical to SEQ ID NO: 21
  Description of Artificial Sequence: Synthetic polypeptide

SEQ ID NO: 580 - protein, 31 aa, Artificial Sequence; identical to SEQ ID NO: 21
  Description of Artificial Sequence: Synthetic polypeptide

SEQ ID NO: 581 - protein, 31 aa, Artificial Sequence; identical to SEQ ID NO: 21
  Description of Artificial Sequence: Synthetic polypeptide

SEQ ID NO: 582 - protein, 31 aa, Artificial Sequence; identical to SEQ ID NO: 21
  Description of Artificial Sequence: Synthetic polypeptide

SEQ ID NO: 583 - protein, 31 aa, Artificial Sequence; identical to SEQ ID NO: 21
  Description of Artificial Sequence: Synthetic polypeptide

SEQ ID NO: 584 - protein, 31 aa, Artificial Sequence; identical to SEQ ID NO: 21
  Description of Artificial Sequence: Synthetic polypeptide

SEQ ID NO: 585 - protein, 31 aa, Artificial Sequence; identical to SEQ ID NO: 21
  Description of Artificial Sequence: Synthetic polypeptide

SEQ ID NO: 586 - protein, 31 aa, Artificial Sequence; identical to SEQ ID NO: 21
  Description of Artificial Sequence: Synthetic polypeptide

SEQ ID NO: 587 - protein, 31 aa, Artificial Sequence; identical to SEQ ID NO: 21
  Description of Artificial Sequence: Synthetic polypeptide

SEQ ID NO: 588 - protein, 31 aa, Artificial Sequence; identical to SEQ ID NO: 21
  Description of Artificial Sequence: Synthetic polypeptide

SEQ ID NO: 589 - protein, 31 aa, Artificial Sequence
  Description of Artificial Sequence: Synthetic polypeptide
ISSFCCRGGSCPSHDTSYCGGQYKSYYYMDV

SEQ ID NO: 590 - protein, 31 aa, Artificial Sequence
  Description of Artificial Sequence: Synthetic polypeptide
TTSFCCRGGSCPSHDTSYCGGQYKSYYYMDV

SEQ ID NO: 591 - protein, 31 aa, Artificial Sequence
  Description of Artificial Sequence: Synthetic polypeptide
TSPFCCRGGSCPSHDTSYCGGQYKSYYYMDV

SEQ ID NO: 592 - protein, 31 aa, Artificial Sequence
  Description of Artificial Sequence: Synthetic polypeptide
TSAFCCRGGSCPSHDTSYCGGQYKSYYYMDV

SEQ ID NO: 593 - protein, 31 aa, Artificial Sequence
  Description of Artificial Sequence: Synthetic polypeptide
TSSYCCRGGSCPSHDTSYCGGQYKSYYYMDV

SEQ ID NO: 594 - protein, 31 aa, Artificial Sequence
  Description of Artificial Sequence: Synthetic polypeptide
TSSFCCLGGSCPSHDTSYCGGQYKSYYYMDV

SEQ ID NO: 595 - protein, 31 aa, Artificial Sequence
  Description of Artificial Sequence: Synthetic polypeptide
TSSFCCHGGSCPSHDTSYCGGQYKSYYYMDV

SEQ ID NO: 596 - protein, 31 aa, Artificial Sequence
  Description of Artificial Sequence: Synthetic polypeptide
TSSFCCQGGSCPSHDTSYCGGQYKSYYYMDV

SEQ ID NO: 597 - protein, 31 aa, Artificial Sequence
  Description of Artificial Sequence: Synthetic polypeptide
TSSFCCRSGSCPSHDTSYCGGQYKSYYYMDV

SEQ ID NO: 598 - protein, 31 aa, Artificial Sequence
  Description of Artificial Sequence: Synthetic polypeptide
TSSFCCRGASCPSHDTSYCGGQYKSYYYMDV

SEQ ID NO: 599 - protein, 31 aa, Artificial Sequence
  Description of Artificial Sequence: Synthetic polypeptide
TSSFCCRGKSCPSHDTSYCGGQYKSYYYMDV

SEQ ID NO: 600 - protein, 31 aa, Artificial Sequence
  Description of Artificial Sequence: Synthetic polypeptide
TSSFCCRGNSCPSHDTSYCGGQYKSYYYMDV

SEQ ID NO: 601 - protein, 31 aa, Artificial Sequence
  Description of Artificial Sequence: Synthetic polypeptide
TSSFCCRGGNCPSHDTSYCGGQYKSYYYMDV

SEQ ID NO: 602 - protein, 31 aa, Artificial Sequence
  Description of Artificial Sequence: Synthetic polypeptide
TSSFCCRGGQCPSHDTSYCGGQYKSYYYMDV

SEQ ID NO: 603 - protein, 31 aa, Artificial Sequence
  Description of Artificial Sequence: Synthetic polypeptide
TSSFCCRGGACPSHDTSYCGGQYKSYYYMDV

SEQ ID NO: 604 - protein, 31 aa, Artificial Sequence
  Description of Artificial Sequence: Synthetic polypeptide
TSSFCCRGGSCASHDTSYCGGQYKSYYYMDV

SEQ ID NO: 605 - protein, 31 aa, Artificial Sequence
  Description of Artificial Sequence: Synthetic polypeptide
TSSFCCRGGSCLSHDTSYCGGQYKSYYYMDV

SEQ ID NO: 606 - protein, 31 aa, Artificial Sequence
  Description of Artificial Sequence: Synthetic polypeptide
TSSFCCRGGSCPAHDTSYCGGQYKSYYYMDV

SEQ ID NO: 607 - protein, 31 aa, Artificial Sequence
  Description of Artificial Sequence: Synthetic polypeptide
TSSFCCRGGSCPNHDTSYCGGQYKSYYYMDV

SEQ ID NO: 608 - protein, 31 aa, Artificial Sequence
  Description of Artificial Sequence: Synthetic polypeptide
TSSFCCRGGSCPSSDTSYCGGQYKSYYYMDV

SEQ ID NO: 609 - protein, 31 aa, Artificial Sequence
  Description of Artificial Sequence: Synthetic polypeptide
TSSFCCRGGSCPSQDTSYCGGQYKSYYYMDV

SEQ ID NO: 610 - protein, 31 aa, Artificial Sequence
  Description of Artificial Sequence: Synthetic polypeptide
TSSFCCRGGSCPSHETSYCGGQYKSYYYMDV

SEQ ID NO: 611 - protein, 31 aa, Artificial Sequence
  Description of Artificial Sequence: Synthetic polypeptide
TSSFCCRGGSCPSHDQSYCGGQYKSYYYMDV

SEQ ID NO: 612 - protein, 31 aa, Artificial Sequence
  Description of Artificial Sequence: Synthetic polypeptide
TSSFCCRGGSCPSHDTSMCGGQYKSYYYMDV

SEQ ID NO: 613 - protein, 31 aa, Artificial Sequence
  Description of Artificial Sequence: Synthetic polypeptide
TSSFCCRGGSCPSHDTSYCAGQYKSYYYMDV

SEQ ID NO: 614 - protein, 31 aa, Artificial Sequence
  Description of Artificial Sequence: Synthetic polypeptide
TSSFCCRGGSCPSHDTSYCNGQYKSYYYMDV

SEQ ID NO: 615 - protein, 31 aa, Artificial Sequence
  Description of Artificial Sequence: Synthetic polypeptide
TSSFCCRGGSCPSHDTSYCGNQYKSYYYMDV

SEQ ID NO: 616 - protein, 31 aa, Artificial Sequence
  Description of Artificial Sequence: Synthetic polypeptide
TSSFCCRGGSCPSHDTSYCGAQYKSYYYMDV

SEQ ID NO: 617 - protein, 31 aa, Artificial Sequence
  Description of Artificial Sequence: Synthetic polypeptide
TSSFCCRGGSCPSHDTSYCGGSYKSYYYMDV

SEQ ID NO: 618 - protein, 31 aa, Artificial Sequence; identical to SEQ ID NO: 33
  Description of Artificial Sequence: Synthetic polypeptide

SEQ ID NO: 619 - protein, 31 aa, Artificial Sequence
  Description of Artificial Sequence: Synthetic polypeptide
TSSFCCRGGSCPSHDTSYCGGQFKSYYYMDV

SEQ ID NO: 620 - protein, 31 aa, Artificial Sequence
  Description of Artificial Sequence: Synthetic polypeptide
TSSFCCRGGSCPSHDTSYCGGQYPSYYYMDV

SEQ ID NO: 621 - protein, 31 aa, Artificial Sequence
  Description of Artificial Sequence: Synthetic polypeptide
TSSFCCRGGSCPSHDTSYCGGQYASYYYMDV

SEQ ID NO: 622 - protein, 31 aa, Artificial Sequence
  Description of Artificial Sequence: Synthetic polypeptide
TSSFCCRGGSCPSHDTSYCGGQYQSYYYMDV

SEQ ID NO: 623 - protein, 31 aa, Artificial Sequence
  Description of Artificial Sequence: Synthetic polypeptide
TSSFCCRGGSCPSHDTSYCGGQYKDYYYMDV

SEQ ID NO: 624 - protein, 31 aa, Artificial Sequence; identical to SEQ ID NO: 28
  Description of Artificial Sequence: Synthetic polypeptide

SEQ ID NO: 625 - protein, 31 aa, Artificial Sequence
  Description of Artificial Sequence: Synthetic polypeptide
TSSFCCRGGSCPSHDTSYCGGQYKSYFYMDV

SEQ ID NO: 626 - protein, 31 aa, Artificial Sequence
  Description of Artificial Sequence: Synthetic polypeptide
TSSFCCRGGSCPSHDTSYCGGQYKSYYWMDV

SEQ ID NO: 627 - protein, 31 aa, Artificial Sequence
  Description of Artificial Sequence: Synthetic polypeptide
TSSFCCRGGSCPSHDTSYCGGQYKSYYLMDV

SEQ ID NO: 628 - protein, 31 aa, Artificial Sequence
  Description of Artificial Sequence: Synthetic polypeptide
TSSFCCRGGSCPSHDTSYCGGQYKSYYYVDV

SEQ ID NO: 629 - protein, 31 aa, Artificial Sequence
  Description of Artificial Sequence: Synthetic polypeptide
TSSFCCRGGSCPSHDTSYCGGQYKSYYYFDV

SEQ ID NO: 630 - protein, 31 aa, Artificial Sequence
  Description of Artificial Sequence: Synthetic polypeptide
TSSFCCRGGSCPSHDTSYCGGQYKSYYYMNV

SEQ ID NO: 631 - protein, 31 aa, Artificial Sequence
  Description of Artificial Sequence: Synthetic polypeptide
TSSFCCRGGSCPSHDTSYCGGQYKSYYYMDI

SEQ ID NO: 632 - protein, 31 aa, Artificial Sequence
  Description of Artificial Sequence: Synthetic polypeptide
TSSFCCRGGSCPSHDTSYCGGQYKSYYYMDP

SEQ ID NO: 633 - protein, 31 aa, Artificial Sequence
  Description of Artificial Sequence: Synthetic polypeptide
TSSFCCRGGSCPSHDTSYCGGQFKDYYYMDV

SEQ ID NO: 634 - protein, 31 aa, Artificial Sequence
  Description of Artificial Sequence: Synthetic polypeptide
TSSFCCRGGSCPSHDTSYCGGQSKQYYYMDV

SEQ ID NO: 635 - protein, 31 aa, Artificial Sequence
  Description of Artificial Sequence: Synthetic polypeptide
TSSFCCRGGSCPSHDTSYCGGQSKKYYYMDV

SEQ ID NO: 636 - protein, 31 aa, Artificial Sequence
  Description of Artificial Sequence: Synthetic polypeptide
TSSFSCRGGSCPSHDTSYSGGQYKSYYYMDV

SEQ ID NO: 637 - protein, 31 aa, Artificial Sequence
  Description of Artificial Sequence: Synthetic polypeptide
TSSFACRGGSCPSHDTSYVGGQYKSYYYMDV

SEQ ID NO: 638 - protein, 31 aa, Artificial Sequence
  Description of Artificial Sequence: Synthetic polypeptide
TSSFCCRGNSCPAHDTSYCGGQYPSYYYMDV

SEQ ID NO: 639 - protein, 31 aa, Artificial Sequence
  Description of Artificial Sequence: Synthetic polypeptide
TSSYCCLGGSCPSHDTSYCGGSYKSYYYMDV

SEQ ID NO: 640 - protein, 31 aa, Artificial Sequence
  Description of Artificial Sequence: Synthetic polypeptide
TSSFCCRGKSCPSHDNSYCGGQYASYYYMDV

SEQ ID NO: 641 - protein, 31 aa, Artificial Sequence
  Description of Artificial Sequence: Synthetic polypeptide
TSSYCCRGGSCPSHDTSYCGGQFKSYYYMDP

SEQ ID NO: 642 - protein, 31 aa, Artificial Sequence
  Description of Artificial Sequence: Synthetic polypeptide
TSTFCCRGGSCLSHDTSYCGGQYKSYYWMDV

SEQ ID NO: 643 - protein, 31 aa, Artificial Sequence; identical to SEQ ID NO: 21
  Description of Artificial Sequence: Synthetic polypeptide

SEQ ID NO: 644 - protein, 31 aa, Artificial Sequence; identical to SEQ ID NO: 21
  Description of Artificial Sequence: Synthetic polypeptide

SEQ ID NO: 645 - protein, 31 aa, Artificial Sequence; identical to SEQ ID NO: 21
  Description of Artificial Sequence: Synthetic polypeptide

SEQ ID NO: 646 - protein, 31 aa, Artificial Sequence; identical to SEQ ID NO: 21
  Description of Artificial Sequence: Synthetic polypeptide

SEQ ID NO: 647 - protein, 31 aa, Artificial Sequence; identical to SEQ ID NO: 21
  Description of Artificial Sequence: Synthetic polypeptide

SEQ ID NO: 648 - protein, 31 aa, Artificial Sequence; identical to SEQ ID NO: 21
  Description of Artificial Sequence: Synthetic polypeptide

SEQ ID NO: 649 - protein, 31 aa, Artificial Sequence; identical to SEQ ID NO: 21
  Description of Artificial Sequence: Synthetic polypeptide

SEQ ID NO: 650 - protein, 31 aa, Artificial Sequence; identical to SEQ ID NO: 21
  Description of Artificial Sequence: Synthetic polypeptide

SEQ ID NO: 651 - protein, 31 aa, Artificial Sequence; identical to SEQ ID NO: 21
  Description of Artificial Sequence: Synthetic polypeptide

SEQ ID NO: 652 - protein, 31 aa, Artificial Sequence; identical to SEQ ID NO: 21
  Description of Artificial Sequence: Synthetic polypeptide

SEQ ID NO: 653 - protein, 31 aa, Artificial Sequence; identical to SEQ ID NO: 21
  Description of Artificial Sequence: Synthetic polypeptide

SEQ ID NO: 654 - protein, 31 aa, Artificial Sequence; identical to SEQ ID NO: 21
  Description of Artificial Sequence: Synthetic polypeptide

SEQ ID NO: 655 - protein, 31 aa, Artificial Sequence; identical to SEQ ID NO: 21
  Description of Artificial Sequence: Synthetic polypeptide

SEQ ID NO: 656 - protein, 31 aa, Artificial Sequence; identical to SEQ ID NO: 21
  Description of Artificial Sequence: Synthetic polypeptide

SEQ ID NO: 657 - protein, 31 aa, Artificial Sequence; identical to SEQ ID NO: 21
  Description of Artificial Sequence: Synthetic polypeptide

SEQ ID NO: 658 - protein, 31 aa, Artificial Sequence; identical to SEQ ID NO: 21
  Description of Artificial Sequence: Synthetic polypeptide

SEQ ID NO: 659 - protein, 31 aa, Artificial Sequence; identical to SEQ ID NO: 21
  Description of Artificial Sequence: Synthetic polypeptide

SEQ ID NO: 660 - protein, 31 aa, Artificial Sequence; identical to SEQ ID NO: 21
  Description of Artificial Sequence: Synthetic polypeptide

SEQ ID NO: 661 - protein, 31 aa, Artificial Sequence; identical to SEQ ID NO: 21
  Description of Artificial Sequence: Synthetic polypeptide

SEQ ID NO: 662 - protein, 31 aa, Artificial Sequence; identical to SEQ ID NO: 21
  Description of Artificial Sequence: Synthetic polypeptide

SEQ ID NO: 663 - protein, 31 aa, Artificial Sequence; identical to SEQ ID NO: 21
  Description of Artificial Sequence: Synthetic polypeptide

SEQ ID NO: 664 - protein, 31 aa, Artificial Sequence; identical to SEQ ID NO: 21
  Description of Artificial Sequence: Synthetic polypeptide

SEQ ID NO: 665 - protein, 31 aa, Artificial Sequence; identical to SEQ ID NO: 21
  Description of Artificial Sequence: Synthetic polypeptide

SEQ ID NO: 666 - protein, 31 aa, Artificial Sequence; identical to SEQ ID NO: 21
  Description of Artificial Sequence: Synthetic polypeptide

SEQ ID NO: 667 - protein, 31 aa, Artificial Sequence; identical to SEQ ID NO: 21
  Description of Artificial Sequence: Synthetic polypeptide

SEQ ID NO: 668 - protein, 31 aa, Artificial Sequence; identical to SEQ ID NO: 21
  Description of Artificial Sequence: Synthetic polypeptide

SEQ ID NO: 669 - protein, 31 aa, Artificial Sequence; identical to SEQ ID NO: 21
  Description of Artificial Sequence: Synthetic polypeptide

SEQ ID NO: 670 - protein, 31 aa, Artificial Sequence; identical to SEQ ID NO: 21
  Description of Artificial Sequence: Synthetic polypeptide

SEQ ID NO: 671 - protein, 31 aa, Artificial Sequence; identical to SEQ ID NO: 21
  Description of Artificial Sequence: Synthetic polypeptide

SEQ ID NO: 672 - protein, 31 aa, Artificial Sequence; identical to SEQ ID NO: 21
  Description of Artificial Sequence: Synthetic polypeptide

SEQ ID NO: 673 - protein, 31 aa, Artificial Sequence; identical to SEQ ID NO: 21
  Description of Artificial Sequence: Synthetic polypeptide

SEQ ID NO: 674 - protein, 31 aa, Artificial Sequence; identical to SEQ ID NO: 21
  Description of Artificial Sequence: Synthetic polypeptide

SEQ ID NO: 675 - protein, 31 aa, Artificial Sequence; identical to SEQ ID NO: 21
  Description of Artificial Sequence: Synthetic polypeptide

SEQ ID NO: 676 - protein, 31 aa, Artificial Sequence; identical to SEQ ID NO: 21
  Description of Artificial Sequence: Synthetic polypeptide

SEQ ID NO: 677 - protein, 31 aa, Artificial Sequence; identical to SEQ ID NO: 21
  Description of Artificial Sequence: Synthetic polypeptide

SEQ ID NO: 678 - protein, 31 aa, Artificial Sequence; identical to SEQ ID NO: 21
  Description of Artificial Sequence: Synthetic polypeptide

SEQ ID NO: 679 - protein, 31 aa, Artificial Sequence; identical to SEQ ID NO: 21
  Description of Artificial Sequence: Synthetic polypeptide

SEQ ID NO: 680 - protein, 31 aa, Artificial Sequence; identical to SEQ ID NO: 21
  Description of Artificial Sequence: Synthetic polypeptide

SEQ ID NO: 681 - protein, 31 aa, Artificial Sequence; identical to SEQ ID NO: 21
  Description of Artificial Sequence: Synthetic polypeptide

SEQ ID NO: 682 - protein, 31 aa, Artificial Sequence; identical to SEQ ID NO: 21
  Description of Artificial Sequence: Synthetic polypeptide

SEQ ID NO: 683 - protein, 31 aa, Artificial Sequence; identical to SEQ ID NO: 21
  Description of Artificial Sequence: Synthetic polypeptide

SEQ ID NO: 684 - protein, 31 aa, Artificial Sequence; identical to SEQ ID NO: 21
  Description of Artificial Sequence: Synthetic polypeptide

SEQ ID NO: 685 - protein, 31 aa, Artificial Sequence; identical to SEQ ID NO: 21
  Description of Artificial Sequence: Synthetic polypeptide

SEQ ID NO: 686 - protein, 31 aa, Artificial Sequence; identical to SEQ ID NO: 21
  Description of Artificial Sequence: Synthetic polypeptide

SEQ ID NO: 687 - protein, 31 aa, Artificial Sequence; identical to SEQ ID NO: 21
  Description of Artificial Sequence: Synthetic polypeptide

SEQ ID NO: 688 - protein, 31 aa, Artificial Sequence; identical to SEQ ID NO: 21
  Description of Artificial Sequence: Synthetic polypeptide

SEQ ID NO: 689 - protein, 31 aa, Artificial Sequence; identical to SEQ ID NO: 21
  Description of Artificial Sequence: Synthetic polypeptide

SEQ ID NO: 690 - protein, 31 aa, Artificial Sequence; identical to SEQ ID NO: 21
  Description of Artificial Sequence: Synthetic polypeptide

SEQ ID NO: 691 - protein, 31 aa, Artificial Sequence; identical to SEQ ID NO: 21
  Description of Artificial Sequence: Synthetic polypeptide

SEQ ID NO: 692 - protein, 31 aa, Artificial Sequence; identical to SEQ ID NO: 21
  Description of Artificial Sequence: Synthetic polypeptide

SEQ ID NO: 693 - protein, 31 aa, Artificial Sequence; identical to SEQ ID NO: 21
  Description of Artificial Sequence: Synthetic polypeptide

SEQ ID NO: 694 - protein, 31 aa, Artificial Sequence; identical to SEQ ID NO: 21
  Description of Artificial Sequence: Synthetic polypeptide

SEQ ID NO: 695 - protein, 31 aa, Artificial Sequence; identical to SEQ ID NO: 21
  Description of Artificial Sequence: Synthetic polypeptide

SEQ ID NO: 696 - protein, 31 aa, Artificial Sequence; identical to SEQ ID NO: 21
  Description of Artificial Sequence: Synthetic polypeptide

SEQ ID NO: 697 - protein, 31 aa, Artificial Sequence; identical to SEQ ID NO: 21
  Description of Artificial Sequence: Synthetic polypeptide

SEQ ID NO: 698 - protein, 31 aa, Artificial Sequence; identical to SEQ ID NO: 21
  Description of Artificial Sequence: Synthetic polypeptide

SEQ ID NO: 699 - protein, 31 aa, Artificial Sequence; identical to SEQ ID NO: 21
  Description of Artificial Sequence: Synthetic polypeptide

SEQ ID NO: 700 - protein, 31 aa, Artificial Sequence; identical to SEQ ID NO: 21
  Description of Artificial Sequence: Synthetic polypeptide

SEQ ID NO: 701 - protein, 31 aa, Artificial Sequence
  Description of Artificial Sequence: Synthetic polypeptide
TSSYCCRSGSCPSSDTSYCNGQFKSYYYMDP

SEQ ID NO: 702 - protein, 31 aa, Artificial Sequence
  Description of Artificial Sequence: Synthetic polypeptide
TSSFCCRSGSCPSSDTSYCNGQYKSYYYVNI

SEQ ID NO: 703 - protein, 31 aa, Artificial Sequence
  Description of Artificial Sequence: Synthetic polypeptide
TTSFCCRGASCPSHDTSYCAGSYKSYYYVNI

SEQ ID NO: 704 - protein, 31 aa, Artificial Sequence
  Description of Artificial Sequence: Synthetic polypeptide
TSAFCCRGKSCPSSDTSYCGGQYPSYYYVNI

SEQ ID NO: 705 - protein, 31 aa, Artificial Sequence
  Description of Artificial Sequence: Synthetic polypeptide
TSAFCCRGKSCPSHDTSFCGGQDKRYYYVNI

SEQ ID NO: 706 - protein, 31 aa, Artificial Sequence
  Description of Artificial Sequence: Synthetic polypeptide
TSAFCCRGGNCPSHETSYCNGQNKQYYYMDV

SEQ ID NO: 707 - protein, 31 aa, Artificial Sequence
  Description of Artificial Sequence: Synthetic polypeptide
TSSFCCRGNQCPSSDTSFCGGQDKRYYYMDP

SEQ ID NO: 708 - protein, 31 aa, Artificial Sequence
  Description of Artificial Sequence: Synthetic polypeptide
TTSFCCRGNQCPSHETSYCGGYYKSYFYMDV

SEQ ID NO: 709 - protein, 31 aa, Artificial Sequence
  Description of Artificial Sequence: Synthetic polypeptide
TSSYCCRGKQCPSHDTSYCAGQYADYYYMDV

SEQ ID NO: 710 - protein, 31 aa, Artificial Sequence
  Description of Artificial Sequence: Synthetic polypeptide
ISSFCCRGKQCPSSDTSYCNGQYADYYYMDV

SEQ ID NO: 711 - protein, 31 aa, Artificial Sequence
  Description of Artificial Sequence: Synthetic polypeptide
TSSFCCRGKQCPSSDTSYCNGQYADYYYVNI

SEQ ID NO: 712 - protein, 31 aa, Artificial Sequence
  Description of Artificial Sequence: Synthetic polypeptide
ISSFCCRGKQCPSSDTSFCGGQDKRYYFMDV

SEQ ID NO: 713 - protein, 31 aa, Artificial Sequence
  Description of Artificial Sequence: Synthetic polypeptide
TSAFCCRGKQCPSSDTSYCGGQYASFYYMDV

SEQ ID NO: 714 - protein, 31 aa, Artificial Sequence
  Description of Artificial Sequence: Synthetic polypeptide
TSSFCCQGNNCPSSDTSYCGGYYKDYYYMDV

SEQ ID NO: 715 - protein, 31 aa, Artificial Sequence
  Description of Artificial Sequence: Synthetic polypeptide
TSSFCCQGNNCPSHDTSYCGGQYKSYYYVNI

SEQ ID NO: 716 - protein, 31 aa, Artificial Sequence
  Description of Artificial Sequence: Synthetic polypeptide
TSSFCCQGKNCPSHETSYCGGQYADYYYMDV

SEQ ID NO: 717 - protein, 31 aa, Artificial Sequence
  Description of Artificial Sequence: Synthetic polypeptide
TTSFCCHGNSCPSSDTSYCGGQNKQYYYMDV

SEQ ID NO: 718 - protein, 31 aa, Artificial Sequence
  Description of Artificial Sequence: Synthetic polypeptide
ISSFCCHGNSCPSHDTSYCNGQNKQYYYMDV

SEQ ID NO: 719 - protein, 31 aa, Artificial Sequence
  Description of Artificial Sequence: Synthetic polypeptide
ISSFCCHSNNCPSSDTSYCNGQYKQYYYMDV

SEQ ID NO: 720 - protein, 31 aa, Artificial Sequence
  Description of Artificial Sequence: Synthetic polypeptide
TSSFCCHSNNCPSHDTSYCGGQYKSYYYVNI

SEQ ID NO: 721 - protein, 31 aa, Artificial Sequence
  Description of Artificial Sequence: Synthetic polypeptide
ISSFACHSNNCPSSDTSYVNGYYKQYYFMDV

SEQ ID NO: 722 - protein, 31 aa, Artificial Sequence
  Description of Artificial Sequence: Synthetic polypeptide
TSSFCCHSNNCPSSDTSYCNGQYKQYYYVNI

SEQ ID NO: 723 - protein, 31 aa, Artificial Sequence
  Description of Artificial Sequence: Synthetic polypeptide
TSSFCCLGKACLSHDTSYCGGQYASYYYVNI

SEQ ID NO: 724 - protein, 31 aa, Artificial Sequence
  Description of Artificial Sequence: Synthetic polypeptide
TSSFCCLGKACLSSDTSYCGGYYASYYFVNI

SEQ ID NO: 725 - protein, 31 aa, Artificial Sequence
  Description of Artificial Sequence: Synthetic polypeptide
TSSFACLGKACLSSDTSYVGGYYASYYFVNI

SEQ ID NO: 726 - protein, 31 aa, Artificial Sequence
  Description of Artificial Sequence: Synthetic polypeptide
TSSYCCLGNSCPSSDTSYCGGQFKSYYYMDP

SEQ ID NO: 727 - protein, 31 aa, Artificial Sequence
  Description of Artificial Sequence: Synthetic polypeptide
TSSYCCLGNSCPSSDTSFCGGQDKRYYYMDP

SEQ ID NO: 728 - protein, 31 aa, Artificial Sequence
  Description of Artificial Sequence: Synthetic polypeptide
ISSFCCLGGNCPSSETSYCGNQYPSYYYMDV

SEQ ID NO: 729 - protein, 31 aa, Artificial Sequence
  Description of Artificial Sequence: Synthetic polypeptide
ISSFCCLGGNCPSSETSYCGNYYPSYFYMDV

SEQ ID NO: 730 - protein, 31 aa, Artificial Sequence
  Description of Artificial Sequence: Synthetic polypeptide
TSSFCCLGGNCPSSETSYCGNQYPSYYYVNI

SEQ ID NO: 731 - protein, 31 aa, Artificial Sequence
  Description of Artificial Sequence: Synthetic polypeptide
TTSFACRGNQCPSHETSYVGGYYKSYFYMDV

SEQ ID NO: 732 - protein, 31 aa, Artificial Sequence
  Description of Artificial Sequence: Synthetic polypeptide
TTSFACRGNQCPSSETSYVGGYYKSYFFMDV

SEQ ID NO: 733 - protein, 31 aa, Artificial Sequence
  Description of Artificial Sequence: Synthetic polypeptide
ISSFACRGKQCPSSDTSYVGGQFKSYYFMDV

SEQ ID NO: 734 - protein, 31 aa, Artificial Sequence
  Description of Artificial Sequence: Synthetic polypeptide
TSSFCCRGGSCLSHDTSYCGGQYKSYYWMDV

SEQ ID NO: 735 - protein, 31 aa, Artificial Sequence; identical to SEQ ID NO: 639
  Description of Artificial Sequence: Synthetic polypeptide

SEQ ID NO: 736 - protein, 31 aa, Artificial Sequence; identical to SEQ ID NO: 44
  Description of Artificial Sequence: Synthetic polypeptide

SEQ ID NO: 737 - protein, 31 aa, Artificial Sequence; identical to SEQ ID NO: 637
  Description of Artificial Sequence: Synthetic polypeptide

SEQ ID NO: 738 - protein, 31 aa, Artificial Sequence; identical to SEQ ID NO: 639
  Description of Artificial Sequence: Synthetic polypeptide

SEQ ID NO: 739 - protein, 31 aa, Artificial Sequence
  Description of Artificial Sequence: Synthetic polypeptide
TSSFCCRGKSCPSHDTSYCGGQYASYYYMDV

SEQ ID NO: 740 - protein, 31 aa, Artificial Sequence; identical to SEQ ID NO: 45
  Description of Artificial Sequence: Synthetic polypeptide

SEQ ID NO: 741 - protein, 31 aa, Artificial Sequence; identical to SEQ ID NO: 20
  Description of Artificial Sequence: Synthetic polypeptide

SEQ ID NO: 742 - protein, 31 aa, Artificial Sequence; identical to SEQ ID NO: 46
  Description of Artificial Sequence: Synthetic polypeptide

SEQ ID NO: 743 - protein, 31 aa, Artificial Sequence; identical to SEQ ID NO: 47
  Description of Artificial Sequence: Synthetic polypeptide

SEQ ID NO: 744 - protein, 31 aa, Artificial Sequence; identical to SEQ ID NO: 27
  Description of Artificial Sequence: Synthetic polypeptide

SEQ ID NO: 745 - protein, 31 aa, Artificial Sequence; identical to SEQ ID NO: 21
  Description of Artificial Sequence: Synthetic polypeptide

SEQ ID NO: 746 - protein, 31 aa, Artificial Sequence; identical to SEQ ID NO: 21
  Description of Artificial Sequence: Synthetic polypeptide

SEQ ID NO: 747 - protein, 31 aa, Artificial Sequence; identical to SEQ ID NO: 739
  Description of Artificial Sequence: Synthetic polypeptide

SEQ ID NO: 748 - protein, 31 aa, Artificial Sequence
  Description of Artificial Sequence: Synthetic polypeptide
TSSFCCRSGSCPSSDTSYCNGQYKSYYWMDV

SEQ ID NO: 749 - protein, 31 aa, Artificial Sequence; identical to SEQ ID NO: 37
  Description of Artificial Sequence: Synthetic polypeptide

SEQ ID NO: 750 - protein, 31 aa, Artificial Sequence
  Description of Artificial Sequence: Synthetic polypeptide
TSSFCCRGGSCPSRDTSYCGGQYKSYYFMDV

SEQ ID NO: 751 - protein, 13 aa, Artificial Sequence
  Description of Artificial Sequence: Synthetic peptide
SGSSSNIGSSSVS

SEQ ID NO: 752 - protein, 13 aa, Artificial Sequence
  Description of Artificial Sequence: Synthetic peptide
SGSSSNIGSSSVS

SEQ ID NO: 753 - protein, 13 aa, Artificial Sequence
  Description of Artificial Sequence: Synthetic peptide
SGSSSNIGSSSVS

SEQ ID NO: 754 - protein, 13 aa, Artificial Sequence
  Description of Artificial Sequence: Synthetic peptide
SGSSSNIGSSSVS

SEQ ID NO: 755 - protein, 13 aa, Artificial Sequence
  Description of Artificial Sequence: Synthetic peptide
SGSSSNIGSSSVS

SEQ ID NO: 756 - protein, 13 aa, Artificial Sequence
  Description of Artificial Sequence: Synthetic peptide
SGSSSNIGSSSVS

SEQ ID NO: 757 - protein, 13 aa, Artificial Sequence
  Description of Artificial Sequence: Synthetic peptide
SGSSSNIGSSSVS

SEQ ID NO: 758 - protein, 13 aa, Artificial Sequence
  Description of Artificial Sequence: Synthetic peptide
SGSSSNIGSSSVS

SEQ ID NO: 759 - protein, 13 aa, Artificial Sequence
  Description of Artificial Sequence: Synthetic peptide
SGSSSNIGSSSVS

SEQ ID NO: 760 - protein, 13 aa, Artificial Sequence
  Description of Artificial Sequence: Synthetic peptide
SGSSSNIGSSSVS

SEQ ID NO: 761 - protein, 13 aa, Artificial Sequence
  Description of Artificial Sequence: Synthetic peptide
SGSSSNIGSSSVS

SEQ ID NO: 762 - protein, 13 aa, Artificial Sequence
  Description of Artificial Sequence: Synthetic peptide
SGSSSNIGSSSVS

SEQ ID NO: 763 - protein, 13 aa, Artificial Sequence
  Description of Artificial Sequence: Synthetic peptide
SGSSSNIGSSSVS

SEQ ID NO: 764 - protein, 13 aa, Artificial Sequence
  Description of Artificial Sequence: Synthetic peptide
SGSSSNIGSSSVS

SEQ ID NO: 765 - protein, 13 aa, Artificial Sequence
  Description of Artificial Sequence: Synthetic peptide
SGSSSNIGSSSVS

SEQ ID NO: 766 - protein, 13 aa, Artificial Sequence
  Description of Artificial Sequence: Synthetic peptide
SGSSSNIGSSSVS

SEQ ID NO: 767 - protein, 13 aa, Artificial Sequence
  Description of Artificial Sequence: Synthetic peptide
SGSSSNIGSSSVS

SEQ ID NO: 768 - protein, 13 aa, Artificial Sequence
  Description of Artificial Sequence: Synthetic peptide
SGSSSNIGSSSVS

SEQ ID NO: 769 - protein, 13 aa, Artificial Sequence
  Description of Artificial Sequence: Synthetic peptide
SGSSSNIGSSSVS

SEQ ID NO: 770 - protein, 13 aa, Artificial Sequence
  Description of Artificial Sequence: Synthetic peptide
SGSSSNIGSSSVS

SEQ ID NO: 771 - protein, 13 aa, Artificial Sequence
  Description of Artificial Sequence: Synthetic peptide
SGSSSNIGSSSVS

SEQ ID NO: 772 - protein, 13 aa, Artificial Sequence
  Description of Artificial Sequence: Synthetic peptide
SGSSSNIGSSSVS

SEQ ID NO: 773 - protein, 13 aa, Artificial Sequence
  Description of Artificial Sequence: Synthetic peptide
SGSSSNIGSSSVS

SEQ ID NO: 774 - protein, 13 aa, Artificial Sequence
  Description of Artificial Sequence: Synthetic peptide
SGSSSNIGSSSVS

SEQ ID NO: 775 - protein, 13 aa, Artificial Sequence
  Description of Artificial Sequence: Synthetic peptide
SGSSSNIGSSSVS

SEQ ID NO: 776 - protein, 13 aa, Artificial Sequence
  Description of Artificial Sequence: Synthetic peptide
SGSSSNIGSSSVS

SEQ ID NO: 777 - protein, 13 aa, Artificial Sequence
  Description of Artificial Sequence: Synthetic peptide
SGSSSNIGSSSVS

SEQ ID NO: 778 - protein, 13 aa, Artificial Sequence
  Description of Artificial Sequence: Synthetic peptide
SGSSSNIGSSSVS

SEQ ID NO: 779 - protein, 13 aa, Artificial Sequence
  Description of Artificial Sequence: Synthetic peptide
SGSSSNIGSSSVS

SEQ ID NO: 780 - protein, 13 aa, Artificial Sequence
  Description of Artificial Sequence: Synthetic peptide
SGSSSNIGSSSVS

SEQ ID NO: 781 - protein, 13 aa, Artificial Sequence
  Description of Artificial Sequence: Synthetic peptide
SGSSSNIGSSSVS

SEQ ID NO: 782 - protein, 13 aa, Artificial Sequence
  Description of Artificial Sequence: Synthetic peptide
SGSSSNIGSSSVS

SEQ ID NO: 783 - protein, 13 aa, Artificial Sequence
  Description of Artificial Sequence: Synthetic peptide
SGSSSNIGSSSVS

SEQ ID NO: 784 - protein, 13 aa, Artificial Sequence
  Description of Artificial Sequence: Synthetic peptide
SGSSSNIGSSSVS

SEQ ID NO: 785 - protein, 13 aa, Artificial Sequence
  Description of Artificial Sequence: Synthetic peptide
SGSSSNIGSSSVS

SEQ ID NO: 786 - protein, 13 aa, Artificial Sequence
  Description of Artificial Sequence: Synthetic peptide
SGSSSNIGSSSVS

SEQ ID NO: 787 - protein, 13 aa, Artificial Sequence
  Description of Artificial Sequence: Synthetic peptide
SGSSSNIGSSSVS

SEQ ID NO: 788 - protein, 13 aa, Artificial Sequence
  Description of Artificial Sequence: Synthetic peptide
SGSSSNIGSSSVS

SEQ ID NO: 789 - protein, 13 aa, Artificial Sequence
  Description of Artificial Sequence: Synthetic peptide
SGSSSNIGSSSVS

SEQ ID NO: 790 - protein, 13 aa, Artificial Sequence
  Description of Artificial Sequence: Synthetic peptide
SGSSSNIGSSSVS

SEQ ID NO: 791 - protein, 13 aa, Artificial Sequence
  Description of Artificial Sequence: Synthetic peptide
SGSSSNIGSSSVS

SEQ ID NO: 792 - protein, 13 aa, Artificial Sequence
  Description of Artificial Sequence: Synthetic peptide
SGSSSNIGSSSVS

SEQ ID NO: 793 - protein, 13 aa, Artificial Sequence
  Description of Artificial Sequence: Synthetic peptide
SGSSSNIGSSSVS

SEQ ID NO: 794 - protein, 13 aa, Artificial Sequence
  Description of Artificial Sequence: Synthetic peptide
SGSSSNIGSSSVS

SEQ ID NO: 795 - protein, 13 aa, Artificial Sequence
  Description of Artificial Sequence: Synthetic peptide
SGSSSNIGSSSVS

SEQ ID NO: 796 - protein, 13 aa, Artificial Sequence
  Description of Artificial Sequence: Synthetic peptide
SGSSSNIGSSSVS

SEQ ID NO: 797 - protein, 13 aa, Artificial Sequence
  Description of Artificial Sequence: Synthetic peptide
SGSSSNIGSSSVS

SEQ ID NO: 798 - protein, 13 aa, Artificial Sequence
  Description of Artificial Sequence: Synthetic peptide
SGSSSNIGSSSVS

SEQ ID NO: 799 - protein, 13 aa, Artificial Sequence
  Description of Artificial Sequence: Synthetic peptide
SGSSSNIGSSSVS

SEQ ID NO: 800 - protein, 13 aa, Artificial Sequence
  Description of Artificial Sequence: Synthetic peptide
SGSSSNIGSSSVS

SEQ ID NO: 801 - protein, 13 aa, Artificial Sequence
  Description of Artificial Sequence: Synthetic peptide
SGSSSNIGSSSVS

SEQ ID NO: 802 - protein, 13 aa, Artificial Sequence
  Description of Artificial Sequence: Synthetic peptide
SGSSSNIGSSSVS

SEQ ID NO: 803 - protein, 13 aa, Artificial Sequence
  Description of Artificial Sequence: Synthetic peptide
SGSSSNIGSSSVS

SEQ ID NO: 804 - protein, 13 aa, Artificial Sequence
  Description of Artificial Sequence: Synthetic peptide
SGSSSNIGSSSVS

SEQ ID NO: 805 - protein, 13 aa, Artificial Sequence
  Description of Artificial Sequence: Synthetic peptide
SGSSSNIGSSSVS

SEQ ID NO: 806 - protein, 13 aa, Artificial Sequence
  Description of Artificial Sequence: Synthetic peptide
SGSSSNIGSSSVS

SEQ ID NO: 807 - protein, 13 aa, Artificial Sequence
  Description of Artificial Sequence: Synthetic peptide
SGSSSNIGSSSVS

SEQ ID NO: 808 - protein, 13 aa, Artificial Sequence
  Description of Artificial Sequence: Synthetic peptide
SGSSSNIGSSSVS

SEQ ID NO: 809 - protein, 13 aa, Artificial Sequence
  Description of Artificial Sequence: Synthetic peptide
SGSSSNIGSSSVS

SEQ ID NO: 810 - protein, 13 aa, Artificial Sequence
  Description of Artificial Sequence: Synthetic peptide
SGSSSNIGSSSVS

SEQ ID NO: 811 - protein, 13 aa, Artificial Sequence
  Description of Artificial Sequence: Synthetic peptide
SGSSSNIGSSSVS

SEQ ID NO: 812 - protein, 13 aa, Artificial Sequence
  Description of Artificial Sequence: Synthetic peptide
SGSSSNIGSSSVS

SEQ ID NO: 813 - protein, 13 aa, Artificial Sequence
  Description of Artificial Sequence: Synthetic peptide
SGSSSNIGSSSVS

SEQ ID NO: 814 - protein, 13 aa, Artificial Sequence
  Description of Artificial Sequence: Synthetic peptide
SGSSSNIGSSSVS

SEQ ID NO: 815 - protein, 13 aa, Artificial Sequence
  Description of Artificial Sequence: Synthetic peptide
SGSSSNIGSSSVS

SEQ ID NO: 816 - protein, 13 aa, Artificial Sequence
  Description of Artificial Sequence: Synthetic peptide
SGSSSNIGSSSVS

SEQ ID NO: 817 - protein, 13 aa, Artificial Sequence
  Description of Artificial Sequence: Synthetic peptide
SGSSSNIGSSSVS

SEQ ID NO: 818 - protein, 13 aa, Artificial Sequence
  Description of Artificial Sequence: Synthetic peptide
SGSSSNIGSSSVS

SEQ ID NO: 819 - protein, 13 aa, Artificial Sequence
  Description of Artificial Sequence: Synthetic peptide
SGSSSNIGSSSVS

SEQ ID NO: 820 - protein, 13 aa, Artificial Sequence
  Description of Artificial Sequence: Synthetic peptide
SGSSSNIGSSSVS

SEQ ID NO: 821 - protein, 13 aa, Artificial Sequence
  Description of Artificial Sequence: Synthetic peptide
SGSSSNIGSSSVS

SEQ ID NO: 822 - protein, 13 aa, Artificial Sequence
  Description of Artificial Sequence: Synthetic peptide
SGSSSNIGSSSVS

SEQ ID NO: 823 - protein, 13 aa, Artificial Sequence
  Description of Artificial Sequence: Synthetic peptide
SGSSSNIGSSSVS

SEQ ID NO: 824 - protein, 13 aa, Artificial Sequence
  Description of Artificial Sequence: Synthetic peptide
SGSSSNIGSSSVS

SEQ ID NO: 825 - protein, 13 aa, Artificial Sequence
  Description of Artificial Sequence: Synthetic peptide
SGSSSNIGSSSVS

SEQ ID NO: 826 - protein, 13 aa, Artificial Sequence
  Description of Artificial Sequence: Synthetic peptide
SGSSSNIGSSSVS

SEQ ID NO: 827 - protein, 13 aa, Artificial Sequence
  Description of Artificial Sequence: Synthetic peptide
SGSSSNIGSSSVS

SEQ ID NO: 828 - protein, 13 aa, Artificial Sequence
  Description of Artificial Sequence: Synthetic peptide
SGSSSNIGSSSVS

SEQ ID NO: 829 - protein, 13 aa, Artificial Sequence
  Description of Artificial Sequence: Synthetic peptide
SGSSSNIGSSSVS

SEQ ID NO: 830 - protein, 13 aa, Artificial Sequence
  Description of Artificial Sequence: Synthetic peptide
SGSSSNIGSSSVS

SEQ ID NO: 831 - protein, 13 aa, Artificial Sequence
  Description of Artificial Sequence: Synthetic peptide
SGSSSNIGSSSVS

SEQ ID NO: 832 - protein, 13 aa, Artificial Sequence
  Description of Artificial Sequence: Synthetic peptide
SGSSSNIGSSSVS

SEQ ID NO: 833 - protein, 13 aa, Artificial Sequence
  Description of Artificial Sequence: Synthetic peptide
SGSSSNIGSSSVS

SEQ ID NO: 834 - protein, 13 aa, Artificial Sequence
  Description of Artificial Sequence: Synthetic peptide
SGSSSNIGSSSVS

SEQ ID NO: 835 - protein, 13 aa, Artificial Sequence
  Description of Artificial Sequence: Synthetic peptide
SGSSSNIGSSSVS

SEQ ID NO: 836 - protein, 13 aa, Artificial Sequence
  Description of Artificial Sequence: Synthetic peptide
SGSSSNIGSSSVS

SEQ ID NO: 837 - protein, 13 aa, Artificial Sequence
  Description of Artificial Sequence: Synthetic peptide
TGSSSNIGSSSVS

SEQ ID NO: 838 - protein, 13 aa, Artificial Sequence
  Description of Artificial Sequence: Synthetic peptide
SGSSTNIGSSSVS

SEQ ID NO: 839 - protein, 13 aa, Artificial Sequence
  Description of Artificial Sequence: Synthetic peptide
SGSSSNIGSSSVS

SEQ ID NO: 840 - protein, 13 aa, Artificial Sequence
  Description of Artificial Sequence: Synthetic peptide
TGSSSNIGSSSVS

SEQ ID NO: 841 - protein, 13 aa, Artificial Sequence
  Description of Artificial Sequence: Synthetic peptide
SGASSNIGSSSVS

SEQ ID NO: 842 - protein, 13 aa, Artificial Sequence
  Description of Artificial Sequence: Synthetic peptide
SGSPSNIGSSSVS

SEQ ID NO: 843 - protein, 13 aa, Artificial Sequence
  Description of Artificial Sequence: Synthetic peptide
SGSKSNIGSSSVS

SEQ ID NO: 844 - protein, 13 aa, Artificial Sequence
  Description of Artificial Sequence: Synthetic peptide
SGSSTNIGSSSVS

SEQ ID NO: 845 - protein, 13 aa, Artificial Sequence
  Description of Artificial Sequence: Synthetic peptide
SGSSSDIGSSSVS

SEQ ID NO: 846 - protein, 13 aa, Artificial Sequence
  Description of Artificial Sequence: Synthetic peptide
SGSSSNIQSSSVS

SEQ ID NO: 847 - protein, 13 aa, Artificial Sequence
  Description of Artificial Sequence: Synthetic peptide
SGSSSNIGHSSVS

SEQ ID NO: 848 - protein, 13 aa, Artificial Sequence
  Description of Artificial Sequence: Synthetic peptide
SGSSSNIGSTSVS

SEQ ID NO: 849 - protein, 13 aa, Artificial Sequence
  Description of Artificial Sequence: Synthetic peptide
SGSSSNIGSNSVS

SEQ ID NO: 850 - protein, 13 aa, Artificial Sequence
  Description of Artificial Sequence: Synthetic peptide
SGSSSNIGSASVS

SEQ ID NO: 851 - protein, 13 aa, Artificial Sequence
  Description of Artificial Sequence: Synthetic peptide
SGSSSNIGSSTVS

SEQ ID NO: 852 - protein, 13 aa, Artificial Sequence
  Description of Artificial Sequence: Synthetic peptide
SGSSSNIGSSAVS

SEQ ID NO: 853 - protein, 13 aa, Artificial Sequence
  Description of Artificial Sequence: Synthetic peptide
SGSSSNIGSSYVS

SEQ ID NO: 854 - protein, 13 aa, Artificial Sequence
  Description of Artificial Sequence: Synthetic peptide
SGSSSNIGSSSTS

SEQ ID NO: 855 - protein, 13 aa, Artificial Sequence
  Description of Artificial Sequence: Synthetic peptide
SGSSSNIGSSSVA

SEQ ID NO: 856 - protein, 13 aa, Artificial Sequence
  Description of Artificial Sequence: Synthetic peptide
SGSSSNIGSSSVT

SEQ ID NO: 857 - protein, 13 aa, Artificial Sequence
  Description of Artificial Sequence: Synthetic peptide
SGSSSNIGSSSVS

SEQ ID NO: 858 - protein, 13 aa, Artificial Sequence
  Description of Artificial Sequence: Synthetic peptide
SGSSSNIGSSSVS

SEQ ID NO: 859 - protein, 13 aa, Artificial Sequence
  Description of Artificial Sequence: Synthetic peptide
SGSSSNIGSSSVS

SEQ ID NO: 860 - protein, 13 aa, Artificial Sequence
  Description of Artificial Sequence: Synthetic peptide
SGSSSNIGSSSVS

SEQ ID NO: 861 - protein, 13 aa, Artificial Sequence
  Description of Artificial Sequence: Synthetic peptide
SGSSSNIGSSSVS

SEQ ID NO: 862 - protein, 13 aa, Artificial Sequence
  Description of Artificial Sequence: Synthetic peptide
SGSSSNIGSSSVS

SEQ ID NO: 863 - protein, 13 aa, Artificial Sequence
  Description of Artificial Sequence: Synthetic peptide
SGSSSNIGSSSVS

SEQ ID NO: 864 - protein, 13 aa, Artificial Sequence
  Description of Artificial Sequence: Synthetic peptide
SGSSSNIGSSSVS

SEQ ID NO: 865 - protein, 13 aa, Artificial Sequence
  Description of Artificial Sequence: Synthetic peptide
SGSSSNIGSSSVS

SEQ ID NO: 866 - protein, 13 aa, Artificial Sequence
  Description of Artificial Sequence: Synthetic peptide
SGSSSNIGSSSVS

SEQ ID NO: 867 - protein, 13 aa, Artificial Sequence
  Description of Artificial Sequence: Synthetic peptide
SGSSSNIGSSSVS

SEQ ID NO: 868 - protein, 13 aa, Artificial Sequence
  Description of Artificial Sequence: Synthetic peptide
SGSSSNIGSSSVS

SEQ ID NO: 869 - protein, 13 aa, Artificial Sequence
  Description of Artificial Sequence: Synthetic peptide
SGSSSNIGSSSVS

SEQ ID NO: 870 - protein, 13 aa, Artificial Sequence
  Description of Artificial Sequence: Synthetic peptide
SGSSSNIGSSSVS

SEQ ID NO: 871 - protein, 13 aa, Artificial Sequence
  Description of Artificial Sequence: Synthetic peptide
SGSSSNIGSSSVS

SEQ ID NO: 872 - protein, 13 aa, Artificial Sequence
  Description of Artificial Sequence: Synthetic peptide
SGSSSNIGSSSVS

SEQ ID NO: 873 - protein, 13 aa, Artificial Sequence
  Description of Artificial Sequence: Synthetic peptide
SGSSSNIGSSSVS

SEQ ID NO: 874 - protein, 13 aa, Artificial Sequence
  Description of Artificial Sequence: Synthetic peptide
SGSSSNIGSSSVS

SEQ ID NO: 875 - protein, 13 aa, Artificial Sequence
  Description of Artificial Sequence: Synthetic peptide
SGSSSNIGSSSVS

SEQ ID NO: 876 - protein, 13 aa, Artificial Sequence
  Description of Artificial Sequence: Synthetic peptide
SGSSSNIGSSSVS

SEQ ID NO: 877 - protein, 13 aa, Artificial Sequence
  Description of Artificial Sequence: Synthetic peptide
SGSSSNIGSSSVS

SEQ ID NO: 878 - protein, 13 aa, Artificial Sequence
  Description of Artificial Sequence: Synthetic peptide
SGSSSNIGSSSVS

SEQ ID NO: 879 - protein, 13 aa, Artificial Sequence
  Description of Artificial Sequence: Synthetic peptide
SGSSSNIGSSSVS

SEQ ID NO: 880 - protein, 13 aa, Artificial Sequence
  Description of Artificial Sequence: Synthetic peptide
SGSSSNIGSSSVS

SEQ ID NO: 881 - protein, 13 aa, Artificial Sequence
  Description of Artificial Sequence: Synthetic peptide
SGSSSNIGSSSVS

SEQ ID NO: 882 - protein, 13 aa, Artificial Sequence
  Description of Artificial Sequence: Synthetic peptide
SGSSSNIGSSSVS

SEQ ID NO: 883 - protein, 13 aa, Artificial Sequence
  Description of Artificial Sequence: Synthetic peptide
SGSSSNIGSSSVS

SEQ ID NO: 884 - protein, 13 aa, Artificial Sequence
  Description of Artificial Sequence: Synthetic peptide
SGSSSNIGSSSVS

SEQ ID NO: 885 - protein, 13 aa, Artificial Sequence
  Description of Artificial Sequence: Synthetic peptide
SGSSSNIGSSSVS

SEQ ID NO: 886 - protein, 13 aa, Artificial Sequence
  Description of Artificial Sequence: Synthetic peptide
SGSSSNIGSSSVS

SEQ ID NO: 887 - protein, 13 aa, Artificial Sequence
  Description of Artificial Sequence: Synthetic peptide
SGSSSNIGSSSVS

SEQ ID NO: 888 - protein, 13 aa, Artificial Sequence
  Description of Artificial Sequence: Synthetic peptide
SGSSSNIGSSSVS

SEQ ID NO: 889 - protein, 13 aa, Artificial Sequence
  Description of Artificial Sequence: Synthetic peptide
SGSSSDIGSSSVS

SEQ ID NO: 890 - protein, 13 aa, Artificial Sequence
  Description of Artificial Sequence: Synthetic peptide
HGSESDIGSHDVL

SEQ ID NO: 891 - protein, 13 aa, Artificial Sequence
  Description of Artificial Sequence: Synthetic peptide
SGSSSNIGSSSVS

SEQ ID NO: 892 - protein, 13 aa, Artificial Sequence
  Description of Artificial Sequence: Synthetic peptide
SGSSSNIGSSSVS

SEQ ID NO: 893 - protein, 13 aa, Artificial Sequence
  Description of Artificial Sequence: Synthetic peptide
SGSSSNIGSSSVS

SEQ ID NO: 894 - protein, 13 aa, Artificial Sequence
  Description of Artificial Sequence: Synthetic peptide
SGSSSNIGSSSVS

SEQ ID NO: 895 - protein, 13 aa, Artificial Sequence
  Description of Artificial Sequence: Synthetic peptide
SGSSSNIGSSSVS

SEQ ID NO: 896 - protein, 13 aa, Artificial Sequence
  Description of Artificial Sequence: Synthetic peptide
SGSSSNIGSSSVS

SEQ ID NO: 897 - protein, 13 aa, Artificial Sequence
  Description of Artificial Sequence: Synthetic peptide
SGSSSNIGSSSVS

SEQ ID NO: 898 - protein, 13 aa, Artificial Sequence
  Description of Artificial Sequence: Synthetic peptide
SGSSSNIGSSSVS

SEQ ID NO: 899 - protein, 13 aa, Artificial Sequence
  Description of Artificial Sequence: Synthetic peptide
SGSSSNIGSSSVS

SEQ ID NO: 900 - protein, 13 aa, Artificial Sequence
  Description of Artificial Sequence: Synthetic peptide
SGSSSNIGSSSVS

SEQ ID NO: 901 - protein, 13 aa, Artificial Sequence
  Description of Artificial Sequence: Synthetic peptide
SGSSSNIGSSSVS

SEQ ID NO: 902 - protein, 13 aa, Artificial Sequence
  Description of Artificial Sequence: Synthetic peptide
SGSSSNIGSSSVS

SEQ ID NO: 903 - protein, 13 aa, Artificial Sequence
  Description of Artificial Sequence: Synthetic peptide
SGSSSNIGSSSVS

SEQ ID NO: 904 - protein, 13 aa, Artificial Sequence
  Description of Artificial Sequence: Synthetic peptide
SGSSSNIGSSSVS

SEQ ID NO: 905 - protein, 13 aa, Artificial Sequence
  Description of Artificial Sequence: Synthetic peptide
SGSSSNIGSSSVS

SEQ ID NO: 906 - protein, 13 aa, Artificial Sequence
  Description of Artificial Sequence: Synthetic peptide
SGSSSNIGSSSVS

SEQ ID NO: 907 - protein, 13 aa, Artificial Sequence
  Description of Artificial Sequence: Synthetic peptide
SGSSSNIGSSSVS

SEQ ID NO: 908 - protein, 13 aa, Artificial Sequence
  Description of Artificial Sequence: Synthetic peptide
SGSSSNIGSSSVS

SEQ ID NO: 909 - protein, 13 aa, Artificial Sequence
  Description of Artificial Sequence: Synthetic peptide
SGSSSNIGSSSVS

SEQ ID NO: 910 - protein, 13 aa, Artificial Sequence
  Description of Artificial Sequence: Synthetic peptide
SGSSSNIGSSSVS

SEQ ID NO: 911 - protein, 13 aa, Artificial Sequence
  Description of Artificial Sequence: Synthetic peptide
SGSSSNIGSSSVS

SEQ ID NO: 912 - protein, 13 aa, Artificial Sequence
  Description of Artificial Sequence: Synthetic peptide
SGSSSNIGSSSVS

SEQ ID NO: 913 - protein, 13 aa, Artificial Sequence
  Description of Artificial Sequence: Synthetic peptide
SGSSSNIGSSSVS

SEQ ID NO: 914 - protein, 13 aa, Artificial Sequence
  Description of Artificial Sequence: Synthetic peptide
SGSSSNIGSSSVS

SEQ ID NO: 915 - protein, 13 aa, Artificial Sequence
  Description of Artificial Sequence: Synthetic peptide
SGSSSNIGSSSVS

SEQ ID NO: 916 - protein, 13 aa, Artificial Sequence
  Description of Artificial Sequence: Synthetic peptide
SGSSSNIGSSSVS

SEQ ID NO: 917 - protein, 13 aa, Artificial Sequence
  Description of Artificial Sequence: Synthetic peptide
SGSSSNIGSSSVS

SEQ ID NO: 918 - protein, 13 aa, Artificial Sequence
  Description of Artificial Sequence: Synthetic peptide
SGSSSNIGSSSVS

SEQ ID NO: 919 - protein, 13 aa, Artificial Sequence
  Description of Artificial Sequence: Synthetic peptide
SGSSSNIGSSSVS

SEQ ID NO: 920 - protein, 13 aa, Artificial Sequence
  Description of Artificial Sequence: Synthetic peptide
SGSSSNIGSSSVS

SEQ ID NO: 921 - protein, 13 aa, Artificial Sequence
  Description of Artificial Sequence: Synthetic peptide
SGSSSNIGSSSVS

SEQ ID NO: 922 - protein, 13 aa, Artificial Sequence
  Description of Artificial Sequence: Synthetic peptide
SGSSSNIGSSSVS

SEQ ID NO: 923 - protein, 13 aa, Artificial Sequence
  Description of Artificial Sequence: Synthetic peptide
SGSSSNIGSSSVS

SEQ ID NO: 924 - protein, 13 aa, Artificial Sequence
  Description of Artificial Sequence: Synthetic peptide
SGSSSNIGSSSVS

SEQ ID NO: 925 - protein, 13 aa, Artificial Sequence
  Description of Artificial Sequence: Synthetic peptide
SGSSSNIGSSSVS

SEQ ID NO: 926 - protein, 13 aa, Artificial Sequence
  Description of Artificial Sequence: Synthetic peptide
SGSSSNIGSSSVS

SEQ ID NO: 927 - protein, 13 aa, Artificial Sequence
  Description of Artificial Sequence: Synthetic peptide
SGSSSNIGSSSVS

SEQ ID NO: 928 - protein, 13 aa, Artificial Sequence
  Description of Artificial Sequence: Synthetic peptide
SGSSTNIGSSSVY

SEQ ID NO: 929 - protein, 13 aa, Artificial Sequence
  Description of Artificial Sequence: Synthetic peptide
SGSSTNIGSSSVY

SEQ ID NO: 930 - protein, 13 aa, Artificial Sequence
  Description of Artificial Sequence: Synthetic peptide
TGSSSNIGSSYVS

SEQ ID NO: 931 - protein, 13 aa, Artificial Sequence
  Description of Artificial Sequence: Synthetic peptide
TGSSSNIGSSYVS

SEQ ID NO: 932 - protein, 13 aa, Artificial Sequence
  Description of Artificial Sequence: Synthetic peptide
TGSSSNIGSSYVS

SEQ ID NO: 933 - protein, 13 aa, Artificial Sequence
  Description of Artificial Sequence: Synthetic peptide
TGSSSNIGSSYVS

SEQ ID NO: 934 - protein, 13 aa, Artificial Sequence
  Description of Artificial Sequence: Synthetic peptide
SGSPSNIGSASTS

SEQ ID NO: 935 - protein, 13 aa, Artificial Sequence
  Description of Artificial Sequence: Synthetic peptide
SGSPSNIGSASTS

SEQ ID NO: 936 - protein, 13 aa, Artificial Sequence
  Description of Artificial Sequence: Synthetic peptide
SGSPSNIGSASTS

SEQ ID NO: 937 - protein, 13 aa, Artificial Sequence
  Description of Artificial Sequence: Synthetic peptide
SGSPSNIGSASTS

SEQ ID NO: 938 - protein, 13 aa, Artificial Sequence
  Description of Artificial Sequence: Synthetic peptide
SGSPSNIGSASTS

SEQ ID NO: 939 - protein, 13 aa, Artificial Sequence
  Description of Artificial Sequence: Synthetic peptide
SGASSNIGHSSVY

SEQ ID NO: 940 - protein, 13 aa, Artificial Sequence
  Description of Artificial Sequence: Synthetic peptide
SGSSSNIGSSSVS

SEQ ID NO: 941 - protein, 13 aa, Artificial Sequence
  Description of Artificial Sequence: Synthetic peptide
SGSSSNIGSSSVS

SEQ ID NO: 942 - protein, 13 aa, Artificial Sequence
  Description of Artificial Sequence: Synthetic peptide
SGSSSNIGSSSVT

SEQ ID NO: 943 - protein, 13 aa, Artificial Sequence
  Description of Artificial Sequence: Synthetic peptide
SGSKSNIGSSYVS

SEQ ID NO: 944 - protein, 13 aa, Artificial Sequence
  Description of Artificial Sequence: Synthetic peptide
SGSSSNIGSSSVY

SEQ ID NO: 945 - protein, 7 aa, Artificial Sequence
  Description of Artificial Sequence: Synthetic peptide
KNNQRPS

SEQ ID NO: 946 - protein, 7 aa, Artificial Sequence
  Description of Artificial Sequence: Synthetic peptide
KNNQRPS

SEQ ID NO: 947 - protein, 7 aa, Artificial Sequence
  Description of Artificial Sequence: Synthetic peptide
KNNQRPS

SEQ ID NO: 948 - protein, 7 aa, Artificial Sequence
  Description of Artificial Sequence: Synthetic peptide
KNNQRPS

SEQ ID NO: 949 - protein, 7 aa, Artificial Sequence
  Description of Artificial Sequence: Synthetic peptide
KNNQRPS

SEQ ID NO: 950 - protein, 7 aa, Artificial Sequence
  Description of Artificial Sequence: Synthetic peptide
KNNQRPS

SEQ ID NO: 951 - protein, 7 aa, Artificial Sequence
  Description of Artificial Sequence: Synthetic peptide
KNNQRPS

SEQ ID NO: 952 - protein, 7 aa, Artificial Sequence
  Description of Artificial Sequence: Synthetic peptide
KNNQRPS

SEQ ID NO: 953 - protein, 7 aa, Artificial Sequence
  Description of Artificial Sequence: Synthetic peptide
KNNQRPS

SEQ ID NO: 954 - protein, 7 aa, Artificial Sequence
  Description of Artificial Sequence: Synthetic peptide
KNNQRPS

SEQ ID NO: 955 - protein, 7 aa, Artificial Sequence
  Description of Artificial Sequence: Synthetic peptide
KNNQRPS

SEQ ID NO: 956 - protein, 7 aa, Artificial Sequence
  Description of Artificial Sequence: Synthetic peptide
KNNQRPS

SEQ ID NO: 957 - protein, 7 aa, Artificial Sequence
  Description of Artificial Sequence: Synthetic peptide
KNNQRPS

SEQ ID NO: 958 - protein, 7 aa, Artificial Sequence
  Description of Artificial Sequence: Synthetic peptide
KNNQRPS

SEQ ID NO: 959 - protein, 7 aa, Artificial Sequence
  Description of Artificial Sequence: Synthetic peptide
KNNQRPS

SEQ ID NO: 960 - protein, 7 aa, Artificial Sequence
  Description of Artificial Sequence: Synthetic peptide
KNNQRPS

SEQ ID NO: 961 - protein, 7 aa, Artificial Sequence
  Description of Artificial Sequence: Synthetic peptide
KNNQRPS

SEQ ID NO: 962 - protein, 7 aa, Artificial Sequence
  Description of Artificial Sequence: Synthetic peptide
KNNQRPS

SEQ ID NO: 963 - protein, 7 aa, Artificial Sequence
  Description of Artificial Sequence: Synthetic peptide
KNNQRPS

SEQ ID NO: 964 - protein, 7 aa, Artificial Sequence
  Description of Artificial Sequence: Synthetic peptide
KNNQRPS

SEQ ID NO: 965 - protein, 7 aa, Artificial Sequence
  Description of Artificial Sequence: Synthetic peptide
KNNQRPS

SEQ ID NO: 966 - protein, 7 aa, Artificial Sequence
  Description of Artificial Sequence: Synthetic peptide
KNNQRPS

SEQ ID NO: 967 - protein, 7 aa, Artificial Sequence
  Description of Artificial Sequence: Synthetic peptide
KNNQRPS

SEQ ID NO: 968 - protein, 7 aa, Artificial Sequence
  Description of Artificial Sequence: Synthetic peptide
KNNQRPS

SEQ ID NO: 969 - protein, 7 aa, Artificial Sequence
  Description of Artificial Sequence: Synthetic peptide
KNNQRPS

SEQ ID NO: 970 - protein, 7 aa, Artificial Sequence
  Description of Artificial Sequence: Synthetic peptide
KNNQRPS

SEQ ID NO: 971 - protein, 7 aa, Artificial Sequence
  Description of Artificial Sequence: Synthetic peptide
KNNQRPS

SEQ ID NO: 972 - protein, 7 aa, Artificial Sequence
  Description of Artificial Sequence: Synthetic peptide
KNNQRPS

SEQ ID NO: 973 - protein, 7 aa, Artificial Sequence
  Description of Artificial Sequence: Synthetic peptide
KNNQRPS

SEQ ID NO: 974 - protein, 7 aa, Artificial Sequence
  Description of Artificial Sequence: Synthetic peptide
KNNQRPS

SEQ ID NO: 975 - protein, 7 aa, Artificial Sequence
  Description of Artificial Sequence: Synthetic peptide
KNNQRPS

SEQ ID NO: 976 - protein, 7 aa, Artificial Sequence
  Description of Artificial Sequence: Synthetic peptide
KNNQRPS

SEQ ID NO: 977 - protein, 7 aa, Artificial Sequence
  Description of Artificial Sequence: Synthetic peptide
KNNQRPS

SEQ ID NO: 978 - protein, 7 aa, Artificial Sequence
  Description of Artificial Sequence: Synthetic peptide
KNNQRPS

SEQ ID NO: 979 - protein, 7 aa, Artificial Sequence
  Description of Artificial Sequence: Synthetic peptide
KNNQRPS

SEQ ID NO: 980 - protein, 7 aa, Artificial Sequence
  Description of Artificial Sequence: Synthetic peptide
KNNQRPS

SEQ ID NO: 981 - protein, 7 aa, Artificial Sequence
  Description of Artificial Sequence: Synthetic peptide
KNNQRPS

SEQ ID NO: 982 - protein, 7 aa, Artificial Sequence
  Description of Artificial Sequence: Synthetic peptide
KNNQRPS

SEQ ID NO: 983 - protein, 7 aa, Artificial Sequence
  Description of Artificial Sequence: Synthetic peptide
KNNQRPS

SEQ ID NO: 984 - protein, 7 aa, Artificial Sequence
  Description of Artificial Sequence: Synthetic peptide
KNNQRPS

SEQ ID NO: 985 - protein, 7 aa, Artificial Sequence
  Description of Artificial Sequence: Synthetic peptide
KNNQRPS

SEQ ID NO: 986 - protein, 7 aa, Artificial Sequence
  Description of Artificial Sequence: Synthetic peptide
KNNQRPS

SEQ ID NO: 987 - protein, 7 aa, Artificial Sequence
  Description of Artificial Sequence: Synthetic peptide
KNNQRPS

SEQ ID NO: 988 - protein, 7 aa, Artificial Sequence
  Description of Artificial Sequence: Synthetic peptide
KNNQRPS

SEQ ID NO: 989 - protein, 7 aa, Artificial Sequence
  Description of Artificial Sequence: Synthetic peptide
KNNQRPS

SEQ ID NO: 990 - protein, 7 aa, Artificial Sequence
  Description of Artificial Sequence: Synthetic peptide
KNNQRPS

SEQ ID NO: 991 - protein, 7 aa, Artificial Sequence
  Description of Artificial Sequence: Synthetic peptide
KNNQRPS

SEQ ID NO: 992 - protein, 7 aa, Artificial Sequence
  Description of Artificial Sequence: Synthetic peptide
KNNQRPS

SEQ ID NO: 993 - protein, 7 aa, Artificial Sequence
  Description of Artificial Sequence: Synthetic peptide
KNNQRPS

SEQ ID NO: 994 - protein, 7 aa, Artificial Sequence
  Description of Artificial Sequence: Synthetic peptide
KNNQRPS

SEQ ID NO: 995 - protein, 7 aa, Artificial Sequence
  Description of Artificial Sequence: Synthetic peptide
KNNQRPS

SEQ ID NO: 996 - protein, 7 aa, Artificial Sequence
  Description of Artificial Sequence: Synthetic peptide
KNNQRPS

SEQ ID NO: 997 - protein, 7 aa, Artificial Sequence
  Description of Artificial Sequence: Synthetic peptide
KNNQRPS

SEQ ID NO: 998 - protein, 7 aa, Artificial Sequence
  Description of Artificial Sequence: Synthetic peptide
KNNQRPS

SEQ ID NO: 999 - protein, 7 aa, Artificial Sequence
  Description of Artificial Sequence: Synthetic peptide
KNNQRPS

SEQ ID NO: 1000 - protein, 7 aa, Artificial Sequence
  Description of Artificial Sequence: Synthetic peptide
KNNQRPS

SEQ ID NO: 1001 - protein, 7 aa, Artificial Sequence
  Description of Artificial Sequence: Synthetic peptide
KNNQRPS

SEQ ID NO: 1002 - protein, 7 aa, Artificial Sequence
  Description of Artificial Sequence: Synthetic peptide
KNNQRPS

SEQ ID NO: 1003 - protein, 7 aa, Artificial Sequence
  Description of Artificial Sequence: Synthetic peptide
KNNQRPS

SEQ ID NO: 1004 - protein, 7 aa, Artificial Sequence
  Description of Artificial Sequence: Synthetic peptide
KNNQRPS

SEQ ID NO: 1005 - protein, 7 aa, Artificial Sequence
  Description of Artificial Sequence: Synthetic peptide
KNNQRPS

SEQ ID NO: 1006 - protein, 7 aa, Artificial Sequence
  Description of Artificial Sequence: Synthetic peptide
KNNQRPS

SEQ ID NO: 1007 - protein, 7 aa, Artificial Sequence
  Description of Artificial Sequence: Synthetic peptide
KNNQRPS

SEQ ID NO: 1008 - protein, 7 aa, Artificial Sequence
  Description of Artificial Sequence: Synthetic peptide
KNNQRPS

SEQ ID NO: 1009 - protein, 7 aa, Artificial Sequence
  Description of Artificial Sequence: Synthetic peptide
KNNQRPS

SEQ ID NO: 1010 - protein, 7 aa, Artificial Sequence
  Description of Artificial Sequence: Synthetic peptide
KNNQRPS

SEQ ID NO: 1011 - protein, 7 aa, Artificial Sequence
  Description of Artificial Sequence: Synthetic peptide
KNNQRPS

SEQ ID NO: 1012 - protein, 7 aa, Artificial Sequence
  Description of Artificial Sequence: Synthetic peptide
KNNQRPS

SEQ ID NO: 1013 - protein, 7 aa, Artificial Sequence
  Description of Artificial Sequence: Synthetic peptide
KNNQRPS

SEQ ID NO: 1014 - protein, 7 aa, Artificial Sequence
  Description of Artificial Sequence: Synthetic peptide
KNNQRPS

SEQ ID NO: 1015 - protein, 7 aa, Artificial Sequence
  Description of Artificial Sequence: Synthetic peptide
KNNQRPS

SEQ ID NO: 1016 - protein, 7 aa, Artificial Sequence
  Description of Artificial Sequence: Synthetic peptide
KNNQRPS

SEQ ID NO: 1017 - protein, 7 aa, Artificial Sequence
  Description of Artificial Sequence: Synthetic peptide
KNNQRPS

SEQ ID NO: 1018 - protein, 7 aa, Artificial Sequence
  Description of Artificial Sequence: Synthetic peptide
KNNQRPS

SEQ ID NO: 1019 - protein, 7 aa, Artificial Sequence
  Description of Artificial Sequence: Synthetic peptide
KNNQRPS

SEQ ID NO: 1020 - protein, 7 aa, Artificial Sequence
  Description of Artificial Sequence: Synthetic peptide
KNNQRPS

SEQ ID NO: 1021 - protein, 7 aa, Artificial Sequence
  Description of Artificial Sequence: Synthetic peptide
KNNQRPS

SEQ ID NO: 1022 - protein, 7 aa, Artificial Sequence
  Description of Artificial Sequence: Synthetic peptide
KNNQRPS

SEQ ID NO: 1023 - protein, 7 aa, Artificial Sequence
  Description of Artificial Sequence: Synthetic peptide
KNNQRPS

SEQ ID NO: 1024 - protein, 7 aa, Artificial Sequence
  Description of Artificial Sequence: Synthetic peptide
KNNQRPS

SEQ ID NO: 1025 - protein, 7 aa, Artificial Sequence
  Description of Artificial Sequence: Synthetic peptide
KNNQRPS

SEQ ID NO: 1026 - protein, 7 aa, Artificial Sequence
  Description of Artificial Sequence: Synthetic peptide
KNNQRPS

SEQ ID NO: 1027 - protein, 7 aa, Artificial Sequence
  Description of Artificial Sequence: Synthetic peptide
KNNQRPS

SEQ ID NO: 1028 - protein, 7 aa, Artificial Sequence
  Description of Artificial Sequence: Synthetic peptide
KNNQRPS

SEQ ID NO: 1029 - protein, 7 aa, Artificial Sequence
  Description of Artificial Sequence: Synthetic peptide
KNNQRPS

SEQ ID NO: 1030 - protein, 7 aa, Artificial Sequence
  Description of Artificial Sequence: Synthetic peptide
KNNQRPS

SEQ ID NO: 1031 - protein, 7 aa, Artificial Sequence
  Description of Artificial Sequence: Synthetic peptide
KNNQRPS

SEQ ID NO: 1032 - protein, 7 aa, Artificial Sequence
  Description of Artificial Sequence: Synthetic peptide
KNNYRPS

SEQ ID NO: 1033 - protein, 7 aa, Artificial Sequence
  Description of Artificial Sequence: Synthetic peptide
KNNQRPS

SEQ ID NO: 1034 - protein, 7 aa, Artificial Sequence
  Description of Artificial Sequence: Synthetic peptide
KNNQRPS

SEQ ID NO: 1035 - protein, 7 aa, Artificial Sequence
  Description of Artificial Sequence: Synthetic peptide
KNNQRPS

SEQ ID NO: 1036 - protein, 7 aa, Artificial Sequence
  Description of Artificial Sequence: Synthetic peptide
KNNQRPS

SEQ ID NO: 1037 - protein, 7 aa, Artificial Sequence
  Description of Artificial Sequence: Synthetic peptide
KNNQRPS

SEQ ID NO: 1038 - protein, 7 aa, Artificial Sequence
  Description of Artificial Sequence: Synthetic peptide
KNNQRPS

SEQ ID NO: 1039 - protein, 7 aa, Artificial Sequence
  Description of Artificial Sequence: Synthetic peptide
KNNQRPS

SEQ ID NO: 1040 - protein, 7 aa, Artificial Sequence
  Description of Artificial Sequence: Synthetic peptide
KNNQRPS

SEQ ID NO: 1041 - protein, 7 aa, Artificial Sequence
  Description of Artificial Sequence: Synthetic peptide
KNNQRPS

SEQ ID NO: 1042 - protein, 7 aa, Artificial Sequence
  Description of Artificial Sequence: Synthetic peptide
KNNQRPS

SEQ ID NO: 1043 - protein, 7 aa, Artificial Sequence
  Description of Artificial Sequence: Synthetic peptide
KNNQRPS

SEQ ID NO: 1044 - protein, 7 aa, Artificial Sequence
  Description of Artificial Sequence: Synthetic peptide
KNNQRPS

SEQ ID NO: 1045 - protein, 7 aa, Artificial Sequence
  Description of Artificial Sequence: Synthetic peptide
KNNQRPS

SEQ ID NO: 1046 - protein, 7 aa, Artificial Sequence
  Description of Artificial Sequence: Synthetic peptide
KNNQRPS

SEQ ID NO: 1047 - protein, 7 aa, Artificial Sequence
  Description of Artificial Sequence: Synthetic peptide
KNNQRPS

SEQ ID NO: 1048 - protein, 7 aa, Artificial Sequence
  Description of Artificial Sequence: Synthetic peptide
KNNQRPS

SEQ ID NO: 1049 - protein, 7 aa, Artificial Sequence
  Description of Artificial Sequence: Synthetic peptide
KNNQRPS

SEQ ID NO: 1050 - protein, 7 aa, Artificial Sequence
  Description of Artificial Sequence: Synthetic peptide
KNNQRPS

SEQ ID NO: 1051 - protein, 7 aa, Artificial Sequence
  Description of Artificial Sequence: Synthetic peptide
RNNQRPS

SEQ ID NO: 1052 - protein, 7 aa, Artificial Sequence
  Description of Artificial Sequence: Synthetic peptide
NNNQRPS

SEQ ID NO: 1053 - protein, 7 aa, Artificial Sequence
  Description of Artificial Sequence: Synthetic peptide
MNNQRPS

SEQ ID NO: 1054 - protein, 7 aa, Artificial Sequence
  Description of Artificial Sequence: Synthetic peptide
ANNQRPS

SEQ ID NO: 1055 - protein, 7 aa, Artificial Sequence
  Description of Artificial Sequence: Synthetic peptide
HNNQRPS

SEQ ID NO: 1056 - protein, 7 aa, Artificial Sequence
  Description of Artificial Sequence: Synthetic peptide
KDNQRPS

SEQ ID NO: 1057 - protein, 7 aa, Artificial Sequence
  Description of Artificial Sequence: Synthetic peptide
KNTQRPS

SEQ ID NO: 1058 - protein, 7 aa, Artificial Sequence
  Description of Artificial Sequence: Synthetic peptide
KNNYRPS

SEQ ID NO: 1059 - protein, 7 aa, Artificial Sequence
  Description of Artificial Sequence: Synthetic peptide
KNNARPS

SEQ ID NO: 1060 - protein, 7 aa, Artificial Sequence
  Description of Artificial Sequence: Synthetic peptide
KNNLRPS

SEQ ID NO: 1061 - protein, 7 aa, Artificial Sequence
  Description of Artificial Sequence: Synthetic peptide
KNNQQPS

SEQ ID NO: 1062 - protein, 7 aa, Artificial Sequence
  Description of Artificial Sequence: Synthetic peptide
KNNQRAS

SEQ ID NO: 1063 - protein, 7 aa, Artificial Sequence
  Description of Artificial Sequence: Synthetic peptide
KNNQRPY

SEQ ID NO: 1064 - protein, 7 aa, Artificial Sequence
  Description of Artificial Sequence: Synthetic peptide
KNNQRPL

SEQ ID NO: 1065 - protein, 7 aa, Artificial Sequence
  Description of Artificial Sequence: Synthetic peptide
KNNQRPS

SEQ ID NO: 1066 - protein, 7 aa, Artificial Sequence
  Description of Artificial Sequence: Synthetic peptide
KNNQRPS

SEQ ID NO: 1067 - protein, 7 aa, Artificial Sequence
  Description of Artificial Sequence: Synthetic peptide
KNNQRPS

SEQ ID NO: 1068 - protein, 7 aa, Artificial Sequence
  Description of Artificial Sequence: Synthetic peptide
KNNQRPS

SEQ ID NO: 1069 - protein, 7 aa, Artificial Sequence
  Description of Artificial Sequence: Synthetic peptide
KNNQRPS

SEQ ID NO: 1070 - protein, 7 aa, Artificial Sequence
  Description of Artificial Sequence: Synthetic peptide
KNNQRPS

SEQ ID NO: 1071 - protein, 7 aa, Artificial Sequence
  Description of Artificial Sequence: Synthetic peptide
KNNQRPS

SEQ ID NO: 1072 - protein, 7 aa, Artificial Sequence
  Description of Artificial Sequence: Synthetic peptide
KNNQRPS

SEQ ID NO: 1073 - protein, 7 aa, Artificial Sequence
  Description of Artificial Sequence: Synthetic peptide
KNNQRPS

SEQ ID NO: 1074 - protein, 7 aa, Artificial Sequence
  Description of Artificial Sequence: Synthetic peptide
KNNQRPS

SEQ ID NO: 1075 - protein, 7 aa, Artificial Sequence
  Description of Artificial Sequence: Synthetic peptide
KNNQRPS

SEQ ID NO: 1076 - protein, 7 aa, Artificial Sequence
  Description of Artificial Sequence: Synthetic peptide
KNNQRPS

SEQ ID NO: 1077 - protein, 7 aa, Artificial Sequence
  Description of Artificial Sequence: Synthetic peptide
KNNQRPS

SEQ ID NO: 1078 - protein, 7 aa, Artificial Sequence
  Description of Artificial Sequence: Synthetic peptide
KNNQRPS

SEQ ID NO: 1079 - protein, 7 aa, Artificial Sequence
  Description of Artificial Sequence: Synthetic peptide
KNNQRPS

SEQ ID NO: 1080 - protein, 7 aa, Artificial Sequence
  Description of Artificial Sequence: Synthetic peptide
KNNQRPS

SEQ ID NO: 1081 - protein, 7 aa, Artificial Sequence
  Description of Artificial Sequence: Synthetic peptide
KNNQRPS

SEQ ID NO: 1082 - protein, 7 aa, Artificial Sequence
  Description of Artificial Sequence: Synthetic peptide
KNNQRPS

SEQ ID NO: 1083 - protein, 7 aa, Artificial Sequence
  Description of Artificial Sequence: Synthetic peptide
KNNQRPS

SEQ ID NO: 1084 - protein, 7 aa, Artificial Sequence
  Description of Artificial Sequence: Synthetic peptide
KNNQRPS

SEQ ID NO: 1085 - protein, 7 aa, Artificial Sequence
  Description of Artificial Sequence: Synthetic peptide
KNNQRPS

SEQ ID NO: 1086 - protein, 7 aa, Artificial Sequence
  Description of Artificial Sequence: Synthetic peptide
KNNQRPS

SEQ ID NO: 1087 - protein, 7 aa, Artificial Sequence
  Description of Artificial Sequence: Synthetic peptide
KNNQRPS

SEQ ID NO: 1088 - protein, 7 aa, Artificial Sequence
  Description of Artificial Sequence: Synthetic peptide
KNNQRPS

SEQ ID NO: 1089 - protein, 7 aa, Artificial Sequence
  Description of Artificial Sequence: Synthetic peptide
KNNQRPS

SEQ ID NO: 1090 - protein, 7 aa, Artificial Sequence
  Description of Artificial Sequence: Synthetic peptide
KNNQRPS

SEQ ID NO: 1091 - protein, 7 aa, Artificial Sequence
  Description of Artificial Sequence: Synthetic peptide
KNNQRPS

SEQ ID NO: 1092 - protein, 7 aa, Artificial Sequence
  Description of Artificial Sequence: Synthetic peptide
KNNQRPS

SEQ ID NO: 1093 - protein, 7 aa, Artificial Sequence
  Description of Artificial Sequence: Synthetic peptide
KNNQRPS

SEQ ID NO: 1094 - protein, 7 aa, Artificial Sequence
  Description of Artificial Sequence: Synthetic peptide
KNNQRPS

SEQ ID NO: 1095 - protein, 7 aa, Artificial Sequence
  Description of Artificial Sequence: Synthetic peptide
KNNQRPS

SEQ ID NO: 1096 - protein, 7 aa, Artificial Sequence
  Description of Artificial Sequence: Synthetic peptide
KNNQRPS

SEQ ID NO: 1097 - protein, 7 aa, Artificial Sequence
  Description of Artificial Sequence: Synthetic peptide
KNNQRPS

SEQ ID NO: 1098 - protein, 7 aa, Artificial Sequence
  Description of Artificial Sequence: Synthetic peptide
KNNQRPS

SEQ ID NO: 1099 - protein, 7 aa, Artificial Sequence
  Description of Artificial Sequence: Synthetic peptide
KNNQRPS

SEQ ID NO: 1100 - protein, 7 aa, Artificial Sequence
  Description of Artificial Sequence: Synthetic peptide
KNNQRPS

SEQ ID NO: 1101 - protein, 7 aa, Artificial Sequence
  Description of Artificial Sequence: Synthetic peptide
KNNQRPS

SEQ ID NO: 1102 - protein, 7 aa, Artificial Sequence
  Description of Artificial Sequence: Synthetic peptide
KNNQRPS

SEQ ID NO: 1103 - protein, 7 aa, Artificial Sequence
  Description of Artificial Sequence: Synthetic peptide
KNNQRPS

SEQ ID NO: 1104 - protein, 7 aa, Artificial Sequence
  Description of Artificial Sequence: Synthetic peptide
KNNQRPS

SEQ ID NO: 1105 - protein, 7 aa, Artificial Sequence
  Description of Artificial Sequence: Synthetic peptide
KNNQRPS

SEQ ID NO: 1106 - protein, 7 aa, Artificial Sequence
  Description of Artificial Sequence: Synthetic peptide
KNNQRPS

SEQ ID NO: 1107 - protein, 7 aa, Artificial Sequence
  Description of Artificial Sequence: Synthetic peptide
KNNQRPS

SEQ ID NO: 1108 - protein, 7 aa, Artificial Sequence
  Description of Artificial Sequence: Synthetic peptide
KNNQRPS

SEQ ID NO: 1109 - protein, 7 aa, Artificial Sequence
  Description of Artificial Sequence: Synthetic peptide
KNNQRPS

SEQ ID NO: 1110 - protein, 7 aa, Artificial Sequence
  Description of Artificial Sequence: Synthetic peptide
KNNQRPS

SEQ ID NO: 1111 - protein, 7 aa, Artificial Sequence
  Description of Artificial Sequence: Synthetic peptide
KNNQRPS

SEQ ID NO: 1112 - protein, 7 aa, Artificial Sequence
  Description of Artificial Sequence: Synthetic peptide
KNNQRPS

SEQ ID NO: 1113 - protein, 7 aa, Artificial Sequence
  Description of Artificial Sequence: Synthetic peptide
KNNQRPS

SEQ ID NO: 1114 - protein, 7 aa, Artificial Sequence
  Description of Artificial Sequence: Synthetic peptide
KNNQRPS

SEQ ID NO: 1115 - protein, 7 aa, Artificial Sequence
  Description of Artificial Sequence: Synthetic peptide
KNNQRPS

SEQ ID NO: 1116 - protein, 7 aa, Artificial Sequence
  Description of Artificial Sequence: Synthetic peptide
KNNQRPS

SEQ ID NO: 1117 - protein, 7 aa, Artificial Sequence
  Description of Artificial Sequence: Synthetic peptide
KNNQRPS

SEQ ID NO: 1118 - protein, 7 aa, Artificial Sequence
  Description of Artificial Sequence: Synthetic peptide
KNNQRPS

SEQ ID NO: 1119 - protein, 7 aa, Artificial Sequence
  Description of Artificial Sequence: Synthetic peptide
KNNQRPS

SEQ ID NO: 1120 - protein, 7 aa, Artificial Sequence
  Description of Artificial Sequence: Synthetic peptide
KNNQRPS

SEQ ID NO: 1121 - protein, 7 aa, Artificial Sequence
  Description of Artificial Sequence: Synthetic peptide
KNNQRPS

SEQ ID NO: 1122 - protein, 7 aa, Artificial Sequence
  Description of Artificial Sequence: Synthetic peptide
KNNYRPS

SEQ ID NO: 1123 - protein, 7 aa, Artificial Sequence
  Description of Artificial Sequence: Synthetic peptide
KNNYRAS

SEQ ID NO: 1124 - protein, 7 aa, Artificial Sequence
  Description of Artificial Sequence: Synthetic peptide
KNSLRPQ

SEQ ID NO: 1125 - protein, 7 aa, Artificial Sequence
  Description of Artificial Sequence: Synthetic peptide
KNSLRPQ

SEQ ID NO: 1126 - protein, 7 aa, Artificial Sequence
  Description of Artificial Sequence: Synthetic peptide
KNSLRPQ

SEQ ID NO: 1127 - protein, 7 aa, Artificial Sequence
  Description of Artificial Sequence: Synthetic peptide
KNSLRPQ

SEQ ID NO: 1128 - protein, 7 aa, Artificial Sequence
  Description of Artificial Sequence: Synthetic peptide
KNNQRPS

SEQ ID NO: 1129 - protein, 7 aa, Artificial Sequence
  Description of Artificial Sequence: Synthetic peptide
KNNQRPS

SEQ ID NO: 1130 - protein, 7 aa, Artificial Sequence
  Description of Artificial Sequence: Synthetic peptide
KNNQRPS

SEQ ID NO: 1131 - protein, 7 aa, Artificial Sequence
  Description of Artificial Sequence: Synthetic peptide
KNNQRPS

SEQ ID NO: 1132 - protein, 7 aa, Artificial Sequence
  Description of Artificial Sequence: Synthetic peptide
KNNQRPS

SEQ ID NO: 1133 - protein, 7 aa, Artificial Sequence
  Description of Artificial Sequence: Synthetic peptide
RNNQQPL

SEQ ID NO: 1134 - protein, 7 aa, Artificial Sequence
  Description of Artificial Sequence: Synthetic peptide
KNTQRAS

SEQ ID NO: 1135 - protein, 7 aa, Artificial Sequence
  Description of Artificial Sequence: Synthetic peptide
RNNQQPL

SEQ ID NO: 1136 - protein, 7 aa, Artificial Sequence
  Description of Artificial Sequence: Synthetic peptide
KNNARPS

SEQ ID NO: 1137 - protein, 7 aa, Artificial Sequence
  Description of Artificial Sequence: Synthetic peptide
KDNQRAS

SEQ ID NO: 1138 - protein, 7 aa, Artificial Sequence
  Description of Artificial Sequence: Synthetic peptide
KNNQRPS

SEQ ID NO: 1139 - protein, 11 aa, Artificial Sequence
  Description of Artificial Sequence: Synthetic peptide
STWDESLSVRV

SEQ ID NO: 1140 - protein, 11 aa, Artificial Sequence
  Description of Artificial Sequence: Synthetic peptide
STWDESLSVRV

SEQ ID NO: 1141 - protein, 11 aa, Artificial Sequence
  Description of Artificial Sequence: Synthetic peptide
STWDESLSVRV

SEQ ID NO: 1142 - protein, 11 aa, Artificial Sequence
  Description of Artificial Sequence: Synthetic peptide
STWDESLSVRV

SEQ ID NO: 1143 - protein, 11 aa, Artificial Sequence
  Description of Artificial Sequence: Synthetic peptide
STWDDSLSVRV

SEQ ID NO: 1144 - protein, 11 aa, Artificial Sequence
  Description of Artificial Sequence: Synthetic peptide
STWDDSLSVRV

SEQ ID NO: 1145 - protein, 11 aa, Artificial Sequence
  Description of Artificial Sequence: Synthetic peptide
STWDDSLSVRV

SEQ ID NO: 1146 - protein, 11 aa, Artificial Sequence
  Description of Artificial Sequence: Synthetic peptide
STWDDSLSVRV

SEQ ID NO: 1147 - protein, 11 aa, Artificial Sequence
  Description of Artificial Sequence: Synthetic peptide
STWDDSLSVRV

SEQ ID NO: 1148 - protein, 11 aa, Artificial Sequence
  Description of Artificial Sequence: Synthetic peptide
STWDDSLSVRV

SEQ ID NO: 1149 - protein, 11 aa, Artificial Sequence
  Description of Artificial Sequence: Synthetic peptide
STWDDSLSVRV

SEQ ID NO: 1150 - protein, 11 aa, Artificial Sequence
  Description of Artificial Sequence: Synthetic peptide
STWDDSLSVRV

SEQ ID NO: 1151 - protein, 11 aa, Artificial Sequence
  Description of Artificial Sequence: Synthetic peptide
STWDDSLSVRV

SEQ ID NO: 1152 - protein, 11 aa, Artificial Sequence
  Description of Artificial Sequence: Synthetic peptide
STWDDSLSVRV

SEQ ID NO: 1153 - protein, 11 aa, Artificial Sequence
  Description of Artificial Sequence: Synthetic peptide
STWDDSLSVRV

SEQ ID NO: 1154 - protein, 11 aa, Artificial Sequence
  Description of Artificial Sequence: Synthetic peptide
STWDDSLSVRV

SEQ ID NO: 1155 - protein, 11 aa, Artificial Sequence
  Description of Artificial Sequence: Synthetic peptide
STWDDSLSVRV

SEQ ID NO: 1156 - protein, 11 aa, Artificial Sequence
  Description of Artificial Sequence: Synthetic peptide
STWDDSLSVRV

SEQ ID NO: 1157 - protein, 11 aa, Artificial Sequence
  Description of Artificial Sequence: Synthetic peptide
STWDDSLSVRV

SEQ ID NO: 1158 - protein, 11 aa, Artificial Sequence
  Description of Artificial Sequence: Synthetic peptide
STWDDSLSVRV

SEQ ID NO: 1159 - protein, 11 aa, Artificial Sequence
  Description of Artificial Sequence: Synthetic peptide
STWDDSLSVRV

SEQ ID NO: 1160 - protein, 11 aa, Artificial Sequence
  Description of Artificial Sequence: Synthetic peptide
STWDDSLSVRV

SEQ ID NO: 1161 - protein, 11 aa, Artificial Sequence
  Description of Artificial Sequence: Synthetic peptide
STWDDSLSVRV

SEQ ID NO: 1162 - protein, 11 aa, Artificial Sequence
  Description of Artificial Sequence: Synthetic peptide
STWDDSLSVRV

SEQ ID NO: 1163 - protein, 11 aa, Artificial Sequence
  Description of Artificial Sequence: Synthetic peptide
STWDDSLSVRV

SEQ ID NO: 1164 - protein, 11 aa, Artificial Sequence
  Description of Artificial Sequence: Synthetic peptide
STWDDSLSVRV

SEQ ID NO: 1165 - protein, 11 aa, Artificial Sequence
  Description of Artificial Sequence: Synthetic peptide
STWDDSLSVRV

SEQ ID NO: 1166 - protein, 11 aa, Artificial Sequence
  Description of Artificial Sequence: Synthetic peptide
STWDDSLSVRV

SEQ ID NO: 1167 - protein, 11 aa, Artificial Sequence
  Description of Artificial Sequence: Synthetic peptide
STWDDSLSVRV

SEQ ID NO: 1168 - protein, 11 aa, Artificial Sequence
  Description of Artificial Sequence: Synthetic peptide
STWDDSLSVRV

SEQ ID NO: 1169 - protein, 11 aa, Artificial Sequence
  Description of Artificial Sequence: Synthetic peptide
STWDDSLSVRV

SEQ ID NO: 1170 - protein, 11 aa, Artificial Sequence
  Description of Artificial Sequence: Synthetic peptide
STWDDSLSVRV

SEQ ID NO: 1171 - protein, 11 aa, Artificial Sequence
  Description of Artificial Sequence: Synthetic peptide
STWDDSLSVRV

SEQ ID NO: 1172 - protein, 11 aa, Artificial Sequence
  Description of Artificial Sequence: Synthetic peptide
STWDDSLSVRV

SEQ ID NO: 1173 - protein, 11 aa, Artificial Sequence
  Description of Artificial Sequence: Synthetic peptide
STWDDSLSVRV

SEQ ID NO: 1174 - protein, 11 aa, Artificial Sequence
  Description of Artificial Sequence: Synthetic peptide
STWDDSLSVRV

SEQ ID NO: 1175 - protein, 11 aa, Artificial Sequence
  Description of Artificial Sequence: Synthetic peptide
STWDDSLSVRV

SEQ ID NO: 1176 - protein, 11 aa, Artificial Sequence
  Description of Artificial Sequence: Synthetic peptide
STWDDSLSVRV

SEQ ID NO: 1177 - protein, 11 aa, Artificial Sequence
  Description of Artificial Sequence: Synthetic peptide
STWDDSLSVRV

SEQ ID NO: 1178 - protein, 11 aa, Artificial Sequence
  Description of Artificial Sequence: Synthetic peptide
STWDDSLSVRV

SEQ ID NO: 1179 - protein, 11 aa, Artificial Sequence
  Description of Artificial Sequence: Synthetic peptide
STWDDSLSVRV

SEQ ID NO: 1180 - protein, 11 aa, Artificial Sequence
  Description of Artificial Sequence: Synthetic peptide
STWDDSLSVRV

SEQ ID NO: 1181 - protein, 11 aa, Artificial Sequence
  Description of Artificial Sequence: Synthetic peptide
STWDDSLSVRV

SEQ ID NO: 1182 - protein, 11 aa, Artificial Sequence
  Description of Artificial Sequence: Synthetic peptide
STWDDSLSVRV

SEQ ID NO: 1183 - protein, 11 aa, Artificial Sequence
  Description of Artificial Sequence: Synthetic peptide
STWDDSLSVRV

SEQ ID NO: 1184 - protein, 11 aa, Artificial Sequence
  Description of Artificial Sequence: Synthetic peptide
STWDDSLSVRV

SEQ ID NO: 1185 - protein, 11 aa, Artificial Sequence
  Description of Artificial Sequence: Synthetic peptide
STWDDSLSVRV

SEQ ID NO: 1186 - protein, 11 aa, Artificial Sequence
  Description of Artificial Sequence: Synthetic peptide
STWDDSLSVRV

SEQ ID NO: 1187 - protein, 11 aa, Artificial Sequence
  Description of Artificial Sequence: Synthetic peptide
STWDDSLSVRV

SEQ ID NO: 1188 - protein, 11 aa, Artificial Sequence
  Description of Artificial Sequence: Synthetic peptide
STWDDSLSVRV

SEQ ID NO: 1189 - protein, 11 aa, Artificial Sequence
  Description of Artificial Sequence: Synthetic peptide
STWDDSLSVRV

SEQ ID NO: 1190 - protein, 11 aa, Artificial Sequence
  Description of Artificial Sequence: Synthetic peptide
STWDDSLSVRV

SEQ ID NO: 1191 - protein, 11 aa, Artificial Sequence
  Description of Artificial Sequence: Synthetic peptide
STWDDSLSVRV

SEQ ID NO: 1192 - protein, 11 aa, Artificial Sequence
  Description of Artificial Sequence: Synthetic peptide
STWDDSLSVRV

SEQ ID NO: 1193 - protein, 11 aa, Artificial Sequence
  Description of Artificial Sequence: Synthetic peptide
STWDDSLSVRV

SEQ ID NO: 1194 - protein, 11 aa, Artificial Sequence
  Description of Artificial Sequence: Synthetic peptide
STWDDSLSVRV

SEQ ID NO: 1195 - protein, 11 aa, Artificial Sequence
  Description of Artificial Sequence: Synthetic peptide
STWDDSLSVRV

SEQ ID NO: 1196 - protein, 11 aa, Artificial Sequence
  Description of Artificial Sequence: Synthetic peptide
STWDDSLSVRV

SEQ ID NO: 1197 - protein, 11 aa, Artificial Sequence
  Description of Artificial Sequence: Synthetic peptide
STWDDSLSVRV

SEQ ID NO: 1198 - protein, 11 aa, Artificial Sequence
  Description of Artificial Sequence: Synthetic peptide
STWDDSLSVRV

SEQ ID NO: 1199 - protein, 11 aa, Artificial Sequence
  Description of Artificial Sequence: Synthetic peptide
STWDDSLSVRV

SEQ ID NO: 1200 - protein, 11 aa, Artificial Sequence
  Description of Artificial Sequence: Synthetic peptide
STWDDSLSVRV

SEQ ID NO: 1201 - protein, 11 aa, Artificial Sequence
  Description of Artificial Sequence: Synthetic peptide
STWDDSLSVRV

SEQ ID NO: 1202 - protein, 11 aa, Artificial Sequence
  Description of Artificial Sequence: Synthetic peptide
STWDDSLSVRV

SEQ ID NO: 1203 - protein, 11 aa, Artificial Sequence
  Description of Artificial Sequence: Synthetic peptide
STWDDSLSVRV

SEQ ID NO: 1204 - protein, 11 aa, Artificial Sequence
  Description of Artificial Sequence: Synthetic peptide
STWDDSLSVRV

SEQ ID NO: 1205 - protein, 11 aa, Artificial Sequence
  Description of Artificial Sequence: Synthetic peptide
STWDDSLSVRV

SEQ ID NO: 1206 - protein, 11 aa, Artificial Sequence
  Description of Artificial Sequence: Synthetic peptide
STWDDSLSVRV

SEQ ID NO: 1207 - protein, 11 aa, Artificial Sequence
  Description of Artificial Sequence: Synthetic peptide
STWDDSLSVRV

SEQ ID NO: 1208 - protein, 11 aa, Artificial Sequence
  Description of Artificial Sequence: Synthetic peptide
STWDDSLSVRV

SEQ ID NO: 1209 - protein, 11 aa, Artificial Sequence
  Description of Artificial Sequence: Synthetic peptide
STWDDSLSVRV

SEQ ID NO: 1210 - protein, 11 aa, Artificial Sequence
  Description of Artificial Sequence: Synthetic peptide
STWDDSLSVRV

SEQ ID NO: 1211 - protein, 11 aa, Artificial Sequence
  Description of Artificial Sequence: Synthetic peptide
STWDDSLSVRV

SEQ ID NO: 1212 - protein, 11 aa, Artificial Sequence
  Description of Artificial Sequence: Synthetic peptide
STWDDSLSVRV

SEQ ID NO: 1213 - protein, 11 aa, Artificial Sequence
  Description of Artificial Sequence: Synthetic peptide
STWDDSLSVRV

SEQ ID NO: 1214 - protein, 11 aa, Artificial Sequence
  Description of Artificial Sequence: Synthetic peptide
STWDDSLSVRV

SEQ ID NO: 1215 - protein, 11 aa, Artificial Sequence
  Description of Artificial Sequence: Synthetic peptide
STWDDSLSVRV

SEQ ID NO: 1216 - protein, 11 aa, Artificial Sequence
  Description of Artificial Sequence: Synthetic peptide
STWDDSLSVRV

SEQ ID NO: 1217 - protein, 11 aa, Artificial Sequence
  Description of Artificial Sequence: Synthetic peptide
STWDDSLSVRV

SEQ ID NO: 1218 - protein, 11 aa, Artificial Sequence
  Description of Artificial Sequence: Synthetic peptide
STWDDSLSVRV

SEQ ID NO: 1219 - protein, 11 aa, Artificial Sequence
  Description of Artificial Sequence: Synthetic peptide
STWDDSLSVRV

SEQ ID NO: 1220 - protein, 11 aa, Artificial Sequence
  Description of Artificial Sequence: Synthetic peptide
STWDDSLSVRV

SEQ ID NO: 1221 - protein, 11 aa, Artificial Sequence
  Description of Artificial Sequence: Synthetic peptide
STWDDSLSVRV

SEQ ID NO: 1222 - protein, 11 aa, Artificial Sequence
  Description of Artificial Sequence: Synthetic peptide
STWDDSLSVRV

SEQ ID NO: 1223 - protein, 11 aa, Artificial Sequence
  Description of Artificial Sequence: Synthetic peptide
STWDDSLSVRV

SEQ ID NO: 1224 - protein, 11 aa, Artificial Sequence
  Description of Artificial Sequence: Synthetic peptide
STWDDSLSVRV

SEQ ID NO: 1225 - protein, 11 aa, Artificial Sequence
  Description of Artificial Sequence: Synthetic peptide
STWDDSLSVRV

SEQ ID NO: 1226 - protein, 11 aa, Artificial Sequence
  Description of Artificial Sequence: Synthetic peptide
STWDDSLSVRV

SEQ ID NO: 1227 - protein, 11 aa, Artificial Sequence
  Description of Artificial Sequence: Synthetic peptide
STWDDSLSVRV

SEQ ID NO: 1228 - protein, 11 aa, Artificial Sequence
  Description of Artificial Sequence: Synthetic peptide
STWDDSLSVRV

SEQ ID NO: 1229 - protein, 11 aa, Artificial Sequence
  Description of Artificial Sequence: Synthetic peptide
STWDDSLSVRV

SEQ ID NO: 1230 - protein, 11 aa, Artificial Sequence
  Description of Artificial Sequence: Synthetic peptide
STWDDSLSVRV

SEQ ID NO: 1231 - protein, 11 aa, Artificial Sequence
  Description of Artificial Sequence: Synthetic peptide
STWDDSLSVRV

SEQ ID NO: 1232 - protein, 11 aa, Artificial Sequence
  Description of Artificial Sequence: Synthetic peptide
STWDDSLSVRV

SEQ ID NO: 1233 - protein, 11 aa, Artificial Sequence
  Description of Artificial Sequence: Synthetic peptide
STWDDSLSVRV

SEQ ID NO: 1234 - protein, 11 aa, Artificial Sequence
  Description of Artificial Sequence: Synthetic peptide
STWDDSLSVRV

SEQ ID NO: 1235 - protein, 11 aa, Artificial Sequence
  Description of Artificial Sequence: Synthetic peptide
STWDDSLSVRV

SEQ ID NO: 1236 - protein, 11 aa, Artificial Sequence
  Description of Artificial Sequence: Synthetic peptide
STWDDSLSVRV

SEQ ID NO: 1237 - protein, 11 aa, Artificial Sequence
  Description of Artificial Sequence: Synthetic peptide
STWDDSLSVRV

SEQ ID NO: 1238 - protein, 11 aa, Artificial Sequence
  Description of Artificial Sequence: Synthetic peptide
STWDDSLSVRV

SEQ ID NO: 1239 - protein, 11 aa, Artificial Sequence
  Description of Artificial Sequence: Synthetic peptide
STWDDSLSVRV

SEQ ID NO: 1240 - protein, 11 aa, Artificial Sequence
  Description of Artificial Sequence: Synthetic peptide
STWDDSLSVRV

SEQ ID NO: 1241 - protein, 11 aa, Artificial Sequence
  Description of Artificial Sequence: Synthetic peptide
STWDDSLSVRV

SEQ ID NO: 1242 - protein, 11 aa, Artificial Sequence
  Description of Artificial Sequence: Synthetic peptide
STWDDSLSVRV

SEQ ID NO: 1243 - protein, 11 aa, Artificial Sequence
  Description of Artificial Sequence: Synthetic peptide
STWDDSLSVRV

SEQ ID NO: 1244 - protein, 11 aa, Artificial Sequence
  Description of Artificial Sequence: Synthetic peptide
STWDDSLSVRV

SEQ ID NO: 1245 - protein, 11 aa, Artificial Sequence
  Description of Artificial Sequence: Synthetic peptide
STWDDSLSVRV

SEQ ID NO: 1246 - protein, 11 aa, Artificial Sequence
  Description of Artificial Sequence: Synthetic peptide
STWDDSLSVRV

SEQ ID NO: 1247 - protein, 11 aa, Artificial Sequence
  Description of Artificial Sequence: Synthetic peptide
STWDDSLSVRV

SEQ ID NO: 1248 - protein, 11 aa, Artificial Sequence
  Description of Artificial Sequence: Synthetic peptide
STWDDSLSVRV

SEQ ID NO: 1249 - protein, 11 aa, Artificial Sequence
  Description of Artificial Sequence: Synthetic peptide
STWDDSLSVRV

SEQ ID NO: 1250 - protein, 11 aa, Artificial Sequence
  Description of Artificial Sequence: Synthetic peptide
STWDDSLSVRV

SEQ ID NO: 1251 - protein, 11 aa, Artificial Sequence
  Description of Artificial Sequence: Synthetic peptide
STWDDSLSVRV

SEQ ID NO: 1252 - protein, 11 aa, Artificial Sequence
  Description of Artificial Sequence: Synthetic peptide
STWDDSLSVRV

SEQ ID NO: 1253 - protein, 11 aa, Artificial Sequence
  Description of Artificial Sequence: Synthetic peptide
STWDDSLSVRV

SEQ ID NO: 1254 - protein, 11 aa, Artificial Sequence
  Description of Artificial Sequence: Synthetic peptide
STWDDSLSVRV

SEQ ID NO: 1255 - protein, 11 aa, Artificial Sequence
  Description of Artificial Sequence: Synthetic peptide
STWDDSLSVRV

SEQ ID NO: 1256 - protein, 11 aa, Artificial Sequence
  Description of Artificial Sequence: Synthetic peptide
STWDDSLSVRV

SEQ ID NO: 1257 - protein, 11 aa, Artificial Sequence
  Description of Artificial Sequence: Synthetic peptide
STWDDSLSVRV

SEQ ID NO: 1258 - protein, 11 aa, Artificial Sequence
  Description of Artificial Sequence: Synthetic peptide
STWDDSLSVRV

SEQ ID NO: 1259 - protein, 11 aa, Artificial Sequence
  Description of Artificial Sequence: Synthetic peptide
ATWDDSLSVRV

SEQ ID NO: 1260 - protein, 11 aa, Artificial Sequence
  Description of Artificial Sequence: Synthetic peptide
SSWDDSLSVRV

SEQ ID NO: 1261 - protein, 11 aa, Artificial Sequence
  Description of Artificial Sequence: Synthetic peptide
STFDDSLSVRV

SEQ ID NO: 1262 - protein, 11 aa, Artificial Sequence
  Description of Artificial Sequence: Synthetic peptide
STWDNSLSVRV

SEQ ID NO: 1263 - protein, 11 aa, Artificial Sequence
  Description of Artificial Sequence: Synthetic peptide
STWDDQLSVRV

SEQ ID NO: 1264 - protein, 11 aa, Artificial Sequence
  Description of Artificial Sequence: Synthetic peptide
STWDDALSVRV

SEQ ID NO: 1265 - protein, 11 aa, Artificial Sequence
  Description of Artificial Sequence: Synthetic peptide
STWDDDLSVRV

SEQ ID NO: 1266 - protein, 11 aa, Artificial Sequence
  Description of Artificial Sequence: Synthetic peptide
STWDDSNSVRV

SEQ ID NO: 1267 - protein, 11 aa, Artificial Sequence
  Description of Artificial Sequence: Synthetic peptide
STWDDSSSVRV

SEQ ID NO: 1268 - protein, 11 aa, Artificial Sequence
  Description of Artificial Sequence: Synthetic peptide
STWDDSLNVRV

SEQ ID NO: 1269 - protein, 11 aa, Artificial Sequence
  Description of Artificial Sequence: Synthetic peptide
STWDDSLLVRV

SEQ ID NO: 1270 - protein, 11 aa, Artificial Sequence
  Description of Artificial Sequence: Synthetic peptide
STWDDSLTVRV

SEQ ID NO: 1271 - protein, 11 aa, Artificial Sequence
  Description of Artificial Sequence: Synthetic peptide
STWDDSLSIRV

SEQ ID NO: 1272 - protein, 11 aa, Artificial Sequence
  Description of Artificial Sequence: Synthetic peptide
STWDDSLSVKV

SEQ ID NO: 1273 - protein, 11 aa, Artificial Sequence
  Description of Artificial Sequence: Synthetic peptide
STWDDSLSVWV

SEQ ID NO: 1274 - protein, 11 aa, Artificial Sequence
  Description of Artificial Sequence: Synthetic peptide
STWDDSLSVHV

SEQ ID NO: 1275 - protein, 11 aa, Artificial Sequence
  Description of Artificial Sequence: Synthetic peptide
STWDDSLSVQV

SEQ ID NO: 1276 - protein, 11 aa, Artificial Sequence
  Description of Artificial Sequence: Synthetic peptide
STWDDSLSVRI

SEQ ID NO: 1277 - protein, 11 aa, Artificial Sequence
  Description of Artificial Sequence: Synthetic peptide
STWNDQLSVRV

SEQ ID NO: 1278 - protein, 11 aa, Artificial Sequence
  Description of Artificial Sequence: Synthetic peptide
STWDDSLSVRV

SEQ ID NO: 1279 - protein, 11 aa, Artificial Sequence
  Description of Artificial Sequence: Synthetic peptide
STWDDSLSVRV

SEQ ID NO: 1280 - protein, 11 aa, Artificial Sequence
  Description of Artificial Sequence: Synthetic peptide
STWDDSLSVRV

SEQ ID NO: 1281 - protein, 11 aa, Artificial Sequence
  Description of Artificial Sequence: Synthetic peptide
STWDDSLSVRV

SEQ ID NO: 1282 - protein, 11 aa, Artificial Sequence
  Description of Artificial Sequence: Synthetic peptide
STWDDSLSVRV

SEQ ID NO: 1283 - protein, 11 aa, Artificial Sequence
  Description of Artificial Sequence: Synthetic peptide
STWDDSLSVRV

SEQ ID NO: 1284 - protein, 11 aa, Artificial Sequence
  Description of Artificial Sequence: Synthetic peptide
STWDDSLSVRV

SEQ ID NO: 1285 - protein, 11 aa, Artificial Sequence
  Description of Artificial Sequence: Synthetic peptide
STWDDSLSVRV

SEQ ID NO: 1286 - protein, 11 aa, Artificial Sequence
  Description of Artificial Sequence: Synthetic peptide
STWDDSLSVRV

SEQ ID NO: 1287 - protein, 11 aa, Artificial Sequence
  Description of Artificial Sequence: Synthetic peptide
STWDDSLSVRV

SEQ ID NO: 1288 - protein, 11 aa, Artificial Sequence
  Description of Artificial Sequence: Synthetic peptide
STWDDSLSVRV

SEQ ID NO: 1289 - protein, 11 aa, Artificial Sequence
  Description of Artificial Sequence: Synthetic peptide
STWDDSLSVRV

SEQ ID NO: 1290 - protein, 11 aa, Artificial Sequence
  Description of Artificial Sequence: Synthetic peptide
STWDDSLSVRV

SEQ ID NO: 1291 - protein, 11 aa, Artificial Sequence
  Description of Artificial Sequence: Synthetic peptide
STWDDSLSVRV

SEQ ID NO: 1292 - protein, 11 aa, Artificial Sequence
  Description of Artificial Sequence: Synthetic peptide
STWDDSLSVRV

SEQ ID NO: 1293 - protein, 11 aa, Artificial Sequence
  Description of Artificial Sequence: Synthetic peptide
STWDDSLSVRV

SEQ ID NO: 1294 - protein, 11 aa, Artificial Sequence
  Description of Artificial Sequence: Synthetic peptide
STWDDSLSVRV

SEQ ID NO: 1295 - protein, 11 aa, Artificial Sequence
  Description of Artificial Sequence: Synthetic peptide
STWDDSLSVRV

SEQ ID NO: 1296 - protein, 11 aa, Artificial Sequence
  Description of Artificial Sequence: Synthetic peptide
STWDDSLSVRV

SEQ ID NO: 1297 - protein, 11 aa, Artificial Sequence
  Description of Artificial Sequence: Synthetic peptide
STWDDSLSVRV

SEQ ID NO: 1298 - protein, 11 aa, Artificial Sequence
  Description of Artificial Sequence: Synthetic peptide
STWDDSLSVRV

SEQ ID NO: 1299 - protein, 11 aa, Artificial Sequence
  Description of Artificial Sequence: Synthetic peptide
STWDDSLSVRV

SEQ ID NO: 1300 - protein, 11 aa, Artificial Sequence
  Description of Artificial Sequence: Synthetic peptide
STWDDSLSVRV

SEQ ID NO: 1301 - protein, 11 aa, Artificial Sequence
  Description of Artificial Sequence: Synthetic peptide
STWDDSLSVRV

SEQ ID NO: 1302 - protein, 11 aa, Artificial Sequence
  Description of Artificial Sequence: Synthetic peptide
STWDDSLSVRV

SEQ ID NO: 1303 - protein, 11 aa, Artificial Sequence
  Description of Artificial Sequence: Synthetic peptide
STWDDSLSVRV

SEQ ID NO: 1304 - protein, 11 aa, Artificial Sequence
  Description of Artificial Sequence: Synthetic peptide
STWDDSLSVRV

SEQ ID NO: 1305 - protein, 11 aa, Artificial Sequence
  Description of Artificial Sequence: Synthetic peptide
STWDDSLSVRV

SEQ ID NO: 1306 - protein, 11 aa, Artificial Sequence
  Description of Artificial Sequence: Synthetic peptide
STWDDSLSVRV

SEQ ID NO: 1307 - protein, 11 aa, Artificial Sequence
  Description of Artificial Sequence: Synthetic peptide
STWDDSLSVRV

SEQ ID NO: 1308 - protein, 11 aa, Artificial Sequence
  Description of Artificial Sequence: Synthetic peptide
STWDDSLSVRV

SEQ ID NO: 1309 - protein, 11 aa, Artificial Sequence
  Description of Artificial Sequence: Synthetic peptide
STWDDSLSVRV

SEQ ID NO: 1310 - protein, 11 aa, Artificial Sequence
  Description of Artificial Sequence: Synthetic peptide
STWDDSLSVRV

SEQ ID NO: 1311 - protein, 11 aa, Artificial Sequence
  Description of Artificial Sequence: Synthetic peptide
STWDDSLSVRV

SEQ ID NO: 1312 - protein, 11 aa, Artificial Sequence
  Description of Artificial Sequence: Synthetic peptide
STWDDSLSVRV

SEQ ID NO: 1313 - protein, 11 aa, Artificial Sequence
  Description of Artificial Sequence: Synthetic peptide
STWDDSLSVRV

SEQ ID NO: 1314 - protein, 11 aa, Artificial Sequence
  Description of Artificial Sequence: Synthetic peptide
STWDDSLSVRV

SEQ ID NO: 1315 - protein, 11 aa, Artificial Sequence
  Description of Artificial Sequence: Synthetic peptide
STWDDSLSVRV

SEQ ID NO: 1316 - protein, 11 aa, Artificial Sequence
  Description of Artificial Sequence: Synthetic peptide
STWDDSLSVRV

SEQ ID NO: 1317 - protein, 11 aa, Artificial Sequence
  Description of Artificial Sequence: Synthetic peptide
STWDDSLSVRV

SEQ ID NO: 1318 - protein, 11 aa, Artificial Sequence
  Description of Artificial Sequence: Synthetic peptide
STWDDSLSVRV

SEQ ID NO: 1319 - protein, 11 aa, Artificial Sequence
  Description of Artificial Sequence: Synthetic peptide
STWDDSLSVRV

SEQ ID NO: 1320 - protein, 11 aa, Artificial Sequence
  Description of Artificial Sequence: Synthetic peptide
STWDDSLSVRV

SEQ ID NO: 1321 - protein, 11 aa, Artificial Sequence
  Description of Artificial Sequence: Synthetic peptide
STWDDSLSVRV

SEQ ID NO: 1322 - protein, 11 aa, Artificial Sequence
  Description of Artificial Sequence: Synthetic peptide
STWDDSLSVRV

SEQ ID NO: 1323 - protein, 11 aa, Artificial Sequence
  Description of Artificial Sequence: Synthetic peptide
STWDDSLSVRV

SEQ ID NO: 1324 - protein, 11 aa, Artificial Sequence
  Description of Artificial Sequence: Synthetic peptide
STWDDSLSVRV

SEQ ID NO: 1325 - protein, 11 aa, Artificial Sequence
  Description of Artificial Sequence: Synthetic peptide
STWDDSLSVRV

SEQ ID NO: 1326 - protein, 11 aa, Artificial Sequence
  Description of Artificial Sequence: Synthetic peptide
STWDDSLSVRV

SEQ ID NO: 1327 - protein, 11 aa, Artificial Sequence
  Description of Artificial Sequence: Synthetic peptide
STWDDALSIRV

SEQ ID NO: 1328 - protein, 11 aa, Artificial Sequence
  Description of Artificial Sequence: Synthetic peptide
STWDDALNVRV

SEQ ID NO: 1329 - protein, 11 aa, Artificial Sequence
  Description of Artificial Sequence: Synthetic peptide
SSWDDSSLVRV

SEQ ID NO: 1330 - protein, 11 aa, Artificial Sequence
  Description of Artificial Sequence: Synthetic peptide
ATWDNSLSIRV

SEQ ID NO: 1331 - protein, 11 aa, Artificial Sequence
  Description of Artificial Sequence: Synthetic peptide
STWDDALSVRV

SEQ ID NO: 1332 - protein, 11 aa, Artificial Sequence
  Description of Artificial Sequence: Synthetic peptide
STWDDSLSVRV

SEQ ID NO: 1333 - protein, 140 aa, Artificial Sequence
  Description of Artificial Sequence: Synthetic polypeptide
EVQLVESGGALVKPGGSLRLSCAASGFTFSKAWMTWVRQAPGKGLEWVGRIKSVTEGETTDYAAPVKGRFTISRDDSKSVLYLQMSSLKTEDTAVYFCTSSFCCRGGSCPSHDTSFCGGQDKRYYYMDVWGKGTTVTVSS

SEQ ID NO: 1334 - protein, 140 aa, Artificial Sequence
  Description of Artificial Sequence: Synthetic polypeptide
EVQLVESGGALVKPGGSLRLSCAASGFTFSKAWMTWVRQAPGKGLEWVGRIKSVTEGETTDYAAPVKGRFTISRDDSKSTLYLQMNSLKTEDTAVYYCTSSFCCRGGSCPSHDTSFCGGQDKRYYYMDVWGKGTTVTVSS

SEQ ID NO: 1335 - protein, 140 aa, Artificial Sequence; identical to SEQ ID NO: 107
  Description of Artificial Sequence: Synthetic polypeptide

SEQ ID NO: 1336 - protein, 140 aa, Artificial Sequence; identical to SEQ ID NO: 94
  Description of Artificial Sequence: Synthetic polypeptide

SEQ ID NO: 1337 - protein, 140 aa, Artificial Sequence
  Description of Artificial Sequence: Synthetic polypeptide
EVQLVESGGALVKPGGSLRLSCAASGYTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1338 - protein, 140 aa, Artificial Sequence
  Description of Artificial Sequence: Synthetic polypeptide
EVQLVESGGALVKPGGSLRLSCAASGFDFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1339 - protein, 140 aa, Artificial Sequence
  Description of Artificial Sequence: Synthetic polypeptide
EVQLVESGGALVKPGGSLRLSCAASGFVFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1340 - protein, 140 aa, Artificial Sequence
  Description of Artificial Sequence: Synthetic polypeptide
EVQLVESGGALVKPGGSLRLSCAASGFTYSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1341 - protein, 140 aa, Artificial Sequence
  Description of Artificial Sequence: Synthetic polypeptide
EVQLVESGGALVKPGGSLRLSCAASGFTFAKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1342 - protein, 140 aa, Artificial Sequence
  Description of Artificial Sequence: Synthetic polypeptide
EVQLVESGGALVKPGGSLRLSCAASGFTFSNAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1343 - protein, 140 aa, Artificial Sequence
  Description of Artificial Sequence: Synthetic polypeptide
EVQLVESGGALVKPGGSLRLSCAASGFTFSRAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1344 - protein, 140 aa, Artificial Sequence
  Description of Artificial Sequence: Synthetic polypeptide
EVQLVESGGALVKPGGSLRLSCAASGFTFSMAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1345 - protein, 140 aa, Artificial Sequence
  Description of Artificial Sequence: Synthetic polypeptide
EVQLVESGGALVKPGGSLRLSCAASGFTFSAAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1346 - protein, 140 aa, Artificial Sequence
  Description of Artificial Sequence: Synthetic polypeptide
EVQLVESGGALVKPGGSLRLSCAASGFTFSHAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1347 - protein, 140 aa, Artificial Sequence; identical to SEQ ID NO: 1346
  Description of Artificial Sequence: Synthetic polypeptide

SEQ ID NO: 1348 - protein, 140 aa, Artificial Sequence
  Description of Artificial Sequence: Synthetic polypeptide
EVQLVESGGALVKPGGSLRLSCAASGFTFSKAYMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1349 - protein, 140 aa, Artificial Sequence
  Description of Artificial Sequence: Synthetic polypeptide
EVQLVESGGALVKPGGSLRLSCAASGFTFSKAWFSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1350 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIQSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1351 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKAVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1352 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSATDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1353 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSNTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1354 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVHDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1355 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVDDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1356 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVQDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1357 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTNGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1358 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDAETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1359 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGQTTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1360 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGHTTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1361 - protein, 140 aa, Artificial Sequence; identical to SEQ ID NO: 118
  Description of Artificial Sequence: Synthetic polypeptide

SEQ ID NO: 1362 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGEATDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1363 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYASPVKGRFTISRDDSKSTLYLQMNSLKTEDTAVYYCTSSFCCRGGSCPSHDTSYCGGQYKSYYYMDVWGKGTTVTVSS

SEQ ID NO: 1364 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVQGRFTISRDDSKSTLYLQMNSLKTEDTAVYYCTSSFCCRGGSCPSHDTSYCGGQYKSYYYMDVWGKGTTVTVSS

SEQ ID NO: 1365 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCRGGSCPSHDTSYCGGQYKSYYYMDVWGKGTTVTVSS

SEQ ID NO: 1366 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFCCRGGSCPSHDTSYCGGQYKSYYYMDVWGKGTTVTVSS

SEQ ID NO: 1367 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSPFCCRGGSCPSHDTSYCGGQYKSYYYMDVWGKGTTVTVSS

SEQ ID NO: 1368 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSAFCCRGGSCPSHDTSYCGGQYKSYYYMDVWGKGTTVTVSS

SEQ ID NO: 1369 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSYCCRGGSCPSHDTSYCGGQYKSYYYMDVWGKGTTVTVSS

SEQ ID NO: 1370 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCLGGSCPSHDTSYCGGQYKSYYYMDVWGKGTTVTVSS

SEQ ID NO: 1371 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCHGGSCPSHDTSYCGGQYKSYYYMDVWGKGTTVTVSS

SEQ ID NO: 1372 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCQGGSCPSHDTSYCGGQYKSYYYMDVWGKGTTVTVSS

SEQ ID NO: 1373 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRSGSCPSHDTSYCGGQYKSYYYMDVWGKGTTVTVSS

SEQ ID NO: 1374 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGASCPSHDTSYCGGQYKSYYYMDVWGKGTTVTVSS

SEQ ID NO: 1375 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGKSCPSHDTSYCGGQYKSYYYMDVWGKGTTVTVSS

SEQ ID NO: 1376 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGNSCPSHDTSYCGGQYKSYYYMDVWGKGTTVTVSS

SEQ ID NO: 1377 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGNCPSHDTSYCGGQYKSYYYMDVWGKGTTVTVSS

SEQ ID NO: 1378 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGQCPSHDTSYCGGQYKSYYYMDVWGKGTTVTVSS

SEQ ID NO: 1379 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGACPSHDTSYCGGQYKSYYYMDVWGKGTTVTVSS

SEQ ID NO: 1380 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCASHDTSYCGGQYKSYYYMDVWGKGTTVTVSS

SEQ ID NO: 1381 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCLSHDTSYCGGQYKSYYYMDVWGKGTTVTVSS

SEQ ID NO: 1382 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPAHDTSYCGGQYKSYYYMDVWGKGTTVTVSS

SEQ ID NO: 1383 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPNHDTSYCGGQYKSYYYMDVWGKGTTVTVSS

SEQ ID NO: 1384 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSSDTSYCGGQYKSYYYMDVWGKGTTVTVSS

SEQ ID NO: 1385 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSQDTSYCGGQYKSYYYMDVWGKGTTVTVSS

SEQ ID NO: 1386 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHETSYCGGQYKSYYYMDVWGKGTTVTVSS

SEQ ID NO: 1387 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDQSYCGGQYKSYYYMDVWGKGTTVTVSS

SEQ ID NO: 1388 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSMCGGQYKSYYYMDVWGKGTTVTVSS

SEQ ID NO: 1389 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCAGQYKSYYYMDVWGKGTTVTVSS

SEQ ID NO: 1390 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCNGQYKSYYYMDVWGKGTTVTVSS

SEQ ID NO: 1391 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGNQYKSYYYMDVWGKGTTVTVSS

SEQ ID NO: 1392 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGAQYKSYYYMDVWGKGTTVTVSS

SEQ ID NO: 1393 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGSYKSYYYMDVWGKGTTVTVSS

SEQ ID NO: 1394 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGYYKSYYYMDVWGKGTTVTVSS

SEQ ID NO: 1395 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQFKSYYYMDVWGKGTTVTVSS

SEQ ID NO: 1396 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYPSYYYMDVWGKGTTVTVSS

SEQ ID NO: 1397 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYASYYYMDVWGKGTTVTVSS

SEQ ID NO: 1398 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYQSYYYMDVWGKGTTVTVSS

SEQ ID NO: 1399 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKDYYYMDVWGKGTTVTVSS

SEQ ID NO: 1400 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSFYYMDVWGKGTTVTVSS

SEQ ID NO: 1401 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYFYMDVWGKGTTVTVSS

SEQ ID NO: 1402 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYWMDVWGKGTTVTVSS

SEQ ID NO: 1403 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYLMDVWGKGTTVTVSS

SEQ ID NO: 1404 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYVDVWGKGTTVTVSS

SEQ ID NO: 1405 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYFDVWGKGTTVTVSS

SEQ ID NO: 1406 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMNVWGKGTTVTVSS

SEQ ID NO: 1407 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDIWGKGTTVTVSS

SEQ ID NO: 1408 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDPWGKGTTVTVSS

SEQ ID NO: 1409 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQFKDYYYMDVWGKGTTVTVSS

SEQ ID NO: 1410 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQSKQYYYMDVWGKGTTVTVSS

SEQ ID NO: 1411 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQSKKYYYMDVWGKGTTVTVSS

SEQ ID NO: 1412 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFSCRGGSCPSHDTSYSGGQYKSYYYMDVWGKGTTVTVSS

SEQ ID NO: 1413 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFACRGGSCPSHDTSYVGGQYKSYYYMDVWGKGTTVTVSS

SEQ ID NO: 1414 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGNSCPAHDTSYCGGQYPSYYYMDVWGKGTTVTVSS

SEQ ID NO: 1415 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSYCCLGGSCPSHDTSYCGGSYKSYYYMDVWGKGTTVTVSS

SEQ ID NO: 1416 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGKSCPSHDNSYCGGQYASYYYMDVWGKGTTVTVSS

SEQ ID NO: 1417 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSYCCRGGSCPSHDTSYCGGQFKSYYYMDPWGKGTTVTVSS

SEQ ID NO: 1418 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSTFCCRGGSCLSHDTSYCGGQYKSYYWMDVWGKGTTVTVSS

SEQ ID NO: 1419 - protein, 140 aa, Artificial Sequence
  Description of Artificial Sequence: Synthetic polypeptide
EVQLVESGGALVKPGGSLRLSCAASGFDFSKAWMSWVRQAPGKGLEWVGRIKSVTDGQTTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1420 - protein, 140 aa, Artificial Sequence; identical to SEQ ID NO: 1341
  Description of Artificial Sequence: Synthetic polypeptide

SEQ ID NO: 1421 - protein, 140 aa, Artificial Sequence
  Description of Artificial Sequence: Synthetic polypeptide
EVQLVESGGALVKPGGSLRLSCAASGFDASKAWFTWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1422 - protein, 140 aa, Artificial Sequence; identical to SEQ ID NO: 94
  Description of Artificial Sequence: Synthetic polypeptide

SEQ ID NO: 1423 - protein, 140 aa, Artificial Sequence; identical to SEQ ID NO: 94
  Description of Artificial Sequence: Synthetic polypeptide

SEQ ID NO: 1424 - protein, 140 aa, Artificial Sequence; identical to SEQ ID NO: 94
  Description of Artificial Sequence: Synthetic polypeptide

SEQ ID NO: 1425 - protein, 140 aa, Artificial Sequence; identical to SEQ ID NO: 94
  Description of Artificial Sequence: Synthetic polypeptide

SEQ ID NO: 1426 - protein, 140 aa, Artificial Sequence; identical to SEQ ID NO: 94
  Description of Artificial Sequence: Synthetic polypeptide

SEQ ID NO: 1427 - protein, 140 aa, Artificial Sequence; identical to SEQ ID NO: 94
  Description of Artificial Sequence: Synthetic polypeptide

SEQ ID NO: 1428 - protein, 140 aa, Artificial Sequence; identical to SEQ ID NO: 94
  Description of Artificial Sequence: Synthetic polypeptide

SEQ ID NO: 1429 - protein, 140 aa, Artificial Sequence; identical to SEQ ID NO: 94
  Description of Artificial Sequence: Synthetic polypeptide

SEQ ID NO: 1430 - protein, 140 aa, Artificial Sequence; identical to SEQ ID NO: 94
  Description of Artificial Sequence: Synthetic polypeptide

SEQ ID NO: 1431 - protein, 140 aa, Artificial Sequence; identical to SEQ ID NO: 94
  Description of Artificial Sequence: Synthetic polypeptide

SEQ ID NO: 1432 - protein, 140 aa, Artificial Sequence; identical to SEQ ID NO: 94
  Description of Artificial Sequence: Synthetic polypeptide

SEQ ID NO: 1433 - protein, 140 aa, Artificial Sequence; identical to SEQ ID NO: 94
  Description of Artificial Sequence: Synthetic polypeptide

SEQ ID NO: 1434 - protein, 140 aa, Artificial Sequence; identical to SEQ ID NO: 94
  Description of Artificial Sequence: Synthetic polypeptide

SEQ ID NO: 1435 - protein, 140 aa, Artificial Sequence; identical to SEQ ID NO: 94
  Description of Artificial Sequence: Synthetic polypeptide

SEQ ID NO: 1436 - protein, 140 aa, Artificial Sequence; identical to SEQ ID NO: 94
  Description of Artificial Sequence: Synthetic polypeptide

SEQ ID NO: 1437 - protein, 140 aa, Artificial Sequence; identical to SEQ ID NO: 94
  Description of Artificial Sequence: Synthetic polypeptide

SEQ ID NO: 1438 - protein, 140 aa, Artificial Sequence; identical to SEQ ID NO: 94
  Description of Artificial Sequence: Synthetic polypeptide

SEQ ID NO: 1439 - protein, 140 aa, Artificial Sequence; identical to SEQ ID NO: 94
  Description of Artificial Sequence: Synthetic polypeptide

SEQ ID NO: 1440 - protein, 140 aa, Artificial Sequence; identical to SEQ ID NO: 94
  Description of Artificial Sequence: Synthetic polypeptide

SEQ ID NO: 1441 - protein, 140 aa, Artificial Sequence; identical to SEQ ID NO: 94
  Description of Artificial Sequence: Synthetic polypeptide

SEQ ID NO: 1442 - protein, 140 aa, Artificial Sequence; identical to SEQ ID NO: 94
  Description of Artificial Sequence: Synthetic polypeptide

SEQ ID NO: 1443 - protein, 140 aa, Artificial Sequence; identical to SEQ ID NO: 94
  Description of Artificial Sequence: Synthetic polypeptide

SEQ ID NO: 1444 - protein, 140 aa, Artificial Sequence; identical to SEQ ID NO: 94
  Description of Artificial Sequence: Synthetic polypeptide

SEQ ID NO: 1445 - protein, 140 aa, Artificial Sequence; identical to SEQ ID NO: 94
  Description of Artificial Sequence: Synthetic polypeptide

SEQ ID NO: 1446 - protein, 140 aa, Artificial Sequence; identical to SEQ ID NO: 94
  Description of Artificial Sequence: Synthetic polypeptide

SEQ ID NO: 1447 - protein, 140 aa, Artificial Sequence; identical to SEQ ID NO: 94
  Description of Artificial Sequence: Synthetic polypeptide

SEQ ID NO: 1448 - protein, 140 aa, Artificial Sequence; identical to SEQ ID NO: 94
  Description of Artificial Sequence: Synthetic polypeptide

SEQ ID NO: 1449 - protein, 140 aa, Artificial Sequence; identical to SEQ ID NO: 94
  Description of Artificial Sequence: Synthetic polypeptide

SEQ ID NO: 1450 - protein, 140 aa, Artificial Sequence; identical to SEQ ID NO: 94
  Description of Artificial Sequence: Synthetic polypeptide

SEQ ID NO: 1451 - protein, 140 aa, Artificial Sequence; identical to SEQ ID NO: 94
  Description of Artificial Sequence: Synthetic polypeptide

SEQ ID NO: 1452 - protein, 140 aa, Artificial Sequence; identical to SEQ ID NO: 94
  Description of Artificial Sequence: Synthetic polypeptide

SEQ ID NO: 1453 - protein, 140 aa, Artificial Sequence; identical to SEQ ID NO: 94
  Description of Artificial Sequence: Synthetic polypeptide

SEQ ID NO: 1454 - protein, 140 aa, Artificial Sequence; identical to SEQ ID NO: 94
  Description of Artificial Sequence: Synthetic polypeptide

SEQ ID NO: 1455 - protein, 140 aa, Artificial Sequence; identical to SEQ ID NO: 94
  Description of Artificial Sequence: Synthetic polypeptide

SEQ ID NO: 1456 - protein, 140 aa, Artificial Sequence; identical to SEQ ID NO: 94
  Description of Artificial Sequence: Synthetic polypeptide

SEQ ID NO: 1457 - protein, 140 aa, Artificial Sequence; identical to SEQ ID NO: 94
  Description of Artificial Sequence: Synthetic polypeptide

SEQ ID NO: 1458 - protein, 140 aa, Artificial Sequence; identical to SEQ ID NO: 94
  Description of Artificial Sequence: Synthetic polypeptide

SEQ ID NO: 1459 - protein, 140 aa, Artificial Sequence; identical to SEQ ID NO: 94
  Description of Artificial Sequence: Synthetic polypeptide

SEQ ID NO: 1460 - protein, 140 aa, Artificial Sequence; identical to SEQ ID NO: 94
  Description of Artificial Sequence: Synthetic polypeptide

SEQ ID NO: 1461 - protein, 140 aa, Artificial Sequence; identical to SEQ ID NO: 94
  Description of Artificial Sequence: Synthetic polypeptide

SEQ ID NO: 1462 - protein, 140 aa, Artificial Sequence; identical to SEQ ID NO: 94
  Description of Artificial Sequence: Synthetic polypeptide

SEQ ID NO: 1463 - protein, 140 aa, Artificial Sequence; identical to SEQ ID NO: 94
  Description of Artificial Sequence: Synthetic polypeptide

SEQ ID NO: 1464 - protein, 140 aa, Artificial Sequence; identical to SEQ ID NO: 94
  Description of Artificial Sequence: Synthetic polypeptide

SEQ ID NO: 1465 - protein, 140 aa, Artificial Sequence; identical to SEQ ID NO: 94
  Description of Artificial Sequence: Synthetic polypeptide

SEQ ID NO: 1466 - protein, 140 aa, Artificial Sequence; identical to SEQ ID NO: 94
  Description of Artificial Sequence: Synthetic polypeptide

SEQ ID NO: 1467 - protein, 140 aa, Artificial Sequence; identical to SEQ ID NO: 94
  Description of Artificial Sequence: Synthetic polypeptide

SEQ ID NO: 1468 - protein, 140 aa, Artificial Sequence; identical to SEQ ID NO: 94
  Description of Artificial Sequence: Synthetic polypeptide

SEQ ID NO: 1469 - protein, 140 aa, Artificial Sequence; identical to SEQ ID NO: 94
  Description of Artificial Sequence: Synthetic polypeptide

SEQ ID NO: 1470 - protein, 140 aa, Artificial Sequence; identical to SEQ ID NO: 94
  Description of Artificial Sequence: Synthetic polypeptide

SEQ ID NO: 1471 - protein, 140 aa, Artificial Sequence; identical to SEQ ID NO: 94
  Description of Artificial Sequence: Synthetic polypeptide

SEQ ID NO: 1472 - protein, 140 aa, Artificial Sequence; identical to SEQ ID NO: 94
  Description of Artificial Sequence: Synthetic polypeptide

SEQ ID NO: 1473 - protein, 140 aa, Artificial Sequence
  Description of Artificial Sequence: Synthetic polypeptide
EVQLVESGGALVKPGGSLRLSCAASGFTFSKAWYSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1474 - protein, 140 aa, Artificial Sequence; identical to SEQ ID NO: 78
  Description of Artificial Sequence: Synthetic polypeptide

SEQ ID NO: 1475 - protein, 140 aa, Artificial Sequence; identical to SEQ ID NO: 78
  Description of Artificial Sequence: Synthetic polypeptide

SEQ ID NO: 1476 - protein, 140 aa, Artificial Sequence
  Description of Artificial Sequence: Synthetic polypeptide
EVQLVESGGGLVQPGPSLRLSCTASGFTFSKAWMSWVRQAPGKGLEWVGFIKSVTDGETTEYAASVKGRFTISRDDSKSIAYLQMNSLKTEDTAVYYCTSSFCCRGGSCPSHDTSYCGGQYKSYYYMDVWGKGTTVTVSS

SEQ ID NO: 1477 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSYCCRSGSCPSSDTSYCNGQFKSYYYMDPWGKGTTVTVSS

SEQ ID NO: 1478 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRSGSCPSSDTSYCNGQYKSYYYVNIWGKGTTVTVSS

SEQ ID NO: 1479 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFCCRGASCPSHDTSYCAGSYKSYYYVNIWGKGTTVTVSS

SEQ ID NO: 1480 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSAFCCRGKSCPSSDTSYCGGQYPSYYYVNIWGKGTTVTVSS

SEQ ID NO: 1481 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSAFCCRGKSCPSHDTSFCGGQDKRYYYVNIWGKGTTVTVSS

SEQ ID NO: 1482 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSAFCCRGGNCPSHETSYCNGQNKQYYYMDVWGKGTTVTVSS

SEQ ID NO: 1483 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGNQCPSSDTSFCGGQDKRYYYMDPWGKGTTVTVSS

SEQ ID NO: 1484 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFCCRGNQCPSHETSYCGGYYKSYFYMDVWGKGTTVTVSS

SEQ ID NO: 1485 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSYCCRGKQCPSHDTSYCAGQYADYYYMDVWGKGTTVTVSS

SEQ ID NO: 1486 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCRGKQCPSSDTSYCNGQYADYYYMDVWGKGTTVTVSS

SEQ ID NO: 1487 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGKQCPSSDTSYCNGQYADYYYVNIWGKGTTVTVSS

SEQ ID NO: 1488 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCRGKQCPSSDTSFCGGQDKRYYFMDVWGKGTTVTVSS

SEQ ID NO: 1489 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSAFCCRGKQCPSSDTSYCGGQYASFYYMDVWGKGTTVTVSS

SEQ ID NO: 1490 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCQGNNCPSSDTSYCGGYYKDYYYMDVWGKGTTVTVSS

SEQ ID NO: 1491 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCQGNNCPSHDTSYCGGQYKSYYYVNIWGKGTTVTVSS

SEQ ID NO: 1492 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCQGKNCPSHETSYCGGQYADYYYMDVWGKGTTVTVSS

SEQ ID NO: 1493 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFCCHGNSCPSSDTSYCGGQNKQYYYMDVWGKGTTVTVSS

SEQ ID NO: 1494 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCHGNSCPSHDTSYCNGQNKQYYYMDVWGKGTTVTVSS

SEQ ID NO: 1495 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCHSNNCPSSDTSYCNGQYKQYYYMDVWGKGTTVTVSS

SEQ ID NO: 1496 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCHSNNCPSHDTSYCGGQYKSYYYVNIWGKGTTVTVSS

SEQ ID NO: 1497 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFACHSNNCPSSDTSYVNGYYKQYYFMDVWGKGTTVTVSS

SEQ ID NO: 1498 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCHSNNCPSSDTSYCNGQYKQYYYVNIWGKGTTVTVSS

SEQ ID NO: 1499 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCLGKACLSHDTSYCGGQYASYYYVNIWGKGTTVTVSS

SEQ ID NO: 1500 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCLGKACLSSDTSYCGGYYASYYFVNIWGKGTTVTVSS

SEQ ID NO: 1501 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFACLGKACLSSDTSYVGGYYASYYFVNIWGKGTTVTVSS

SEQ ID NO: 1502 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSYCCLGNSCPSSDTSYCGGQFKSYYYMDPWGKGTTVTVSS

SEQ ID NO: 1503 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSYCCLGNSCPSSDTSFCGGQDKRYYYMDPWGKGTTVTVSS

SEQ ID NO: 1504 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCLGGNCPSSETSYCGNQYPSYYYMDVWGKGTTVTVSS

SEQ ID NO: 1505 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFCCLGGNCPSSETSYCGNYYPSYFYMDVWGKGTTVTVSS

SEQ ID NO: 1506 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCLGGNCPSSETSYCGNQYPSYYYVNIWGKGTTVTVSS

SEQ ID NO: 1507 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFACRGNQCPSHETSYVGGYYKSYFYMDVWGKGTTVTVSS

SEQ ID NO: 1508 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTTSFACRGNQCPSSETSYVGGYYKSYFFMDVWGKGTTVTVSS

SEQ ID NO: 1509 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCISSFACRGKQCPSSDTSYVGGQFKSYYFMDVWGKGTTVTVSS

SEQ ID NO: 1510 - protein, 140 aa, Artificial Sequence
  Description of Artificial Sequence: Synthetic polypeptide
EVQLVESGGALVKPGGSLRLSCAASGFTFAKAWMSWVRQAPGKGLEWVGRIKAADDGKQTDYAAPVKGRFTISRDDSKSTLYLQMNSLKTEDTAVYYCTSSFCCRGGSCLSHDTSYCGGQYKSYYWMDVWGKGTTVTVSS

SEQ ID NO: 1511 - protein, 140 aa, Artificial Sequence
  Description of Artificial Sequence: Synthetic polypeptide
EVQLVESGGALVKPGGSLRLSCAASGFTYAKAWMSWVRQAPGKGLEWVGRIKSVQDGEQTDYAAPVKGRFTISRDDSKSTLYLQMNSLKTEDTAVYYCTSSYCCLGGSCPSHDTSYCGGSYKSYYYMDVWGKGTTVTVSS

SEQ ID NO: 1512 - protein, 140 aa, Artificial Sequence
  Description of Artificial Sequence: Synthetic polypeptide
EVQLVESGGALVKPGGSLRLSCAASGFDASKAWFTWVRQAPGKGLEWVGRIKSVTDGETTDYAAPVKGRFTISRDDSKSTLYLQMNSLKTEDTAVYYCTSSFCCRGGSCPSHDTSYCGGQNKQYYYMDVWGKGTTVTVSS

SEQ ID NO: 1513 - protein, 140 aa, Artificial Sequence
  Description of Artificial Sequence: Synthetic polypeptide
EVQLVESGGALVKPGGSLRLSCAASGFDASKAWFTWVRQAPGKGLEWVGRIKSVTDGETTDYAAPVKGRFTISRDDSKSTLYLQMNSLKTEDTAVYYCTSSFACRGGSCPSHDTSYVGGQYKSYYYMDVWGKGTTVTVSS

SEQ ID NO: 1514 - protein, 140 aa, Artificial Sequence
  Description of Artificial Sequence: Synthetic polypeptide
EVQLVESGGALVKPGGSLRLSCAASGFDASKAWFTWVRQAPGKGLEWVGRIKSVTDGETTDYAAPVKGRFTISRDDSKSTLYLQMNSLKTEDTAVYYCTSSYCCLGGSCPSHDTSYCGGSYKSYYYMDVWGKGTTVTVSS

SEQ ID NO: 1515 - protein, 140 aa, Artificial Sequence
  Description of Artificial Sequence: Synthetic polypeptide
EVQLVESGGALVKPGGSLRLSCAASGFDASKAWFTWVRQAPGKGLEWVGRIKSVTDGETTDYAAPVKGRFTISRDDSKSTLYLQMNSLKTEDTAVYYCTSSFCCRGKSCPSHDTSYCGGQYASYYYMDVWGKGTTVTVSS

SEQ ID NO: 1516 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKAADDGKQTDYAAPVKGRFTISRDDSKSTLYLQMNSLKTEDTAVYYCTSSFCCRGGNCPSHETSYCGNQYKSYYYMDVWGKGTTVTVSS

SEQ ID NO: 1517 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKAADDGKQTDYAAPVKGRFTISRDDSKSTLYLQMNSLKTEDTAVYYCTSSFCCRSGSCPSSDTSYCNGQYKSYYYMDVWGKGTTVTVSS

SEQ ID NO: 1518 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKAADDGKQTDYAAPVKGRFTISRDDSKSTLYLQMNSLKTEDTAVYYCTSSFCCRGGSCPSHDTSYCGGQYKSYYYVNIWGKGTTVTVSS

SEQ ID NO: 1519 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKAADDGKQTDYAAPVKGRFTISRDDSKSTLYLQMNSLKTEDTAVYYCTTSFCCRGASCPSHDTSYCAGSYKSYYYMDVWGKGTTVTVSS

SEQ ID NO: 1520 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKAADDGKQTDYAAPVKGRFTISRDDSKSTLYLQMNSLKTEDTAVYYCISSFCCRGNSCPSSDTSYCNGQYKSYYYMDVWGKGTTVTVSS

SEQ ID NO: 1521 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKAVTDGHTTDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1522 - protein, 140 aa, Artificial Sequence
  Description of Artificial Sequence: Synthetic polypeptide
EVQLVESGGALVKPGGSLRLSCAASGFVYSKAWMSWVRQAPGKGLEWVGRIKSVTDGQATDYAAPVKGRFTISRDDSKSTLYLQMNSLKTEDTAVYYCTSSFCCRGGSCPSHDTSYCGGQYKSYYYMDVWGKGTTVTVSS

SEQ ID NO: 1523 - protein, 140 aa, Artificial Sequence
  Description of Artificial Sequence: Synthetic polypeptide
EVQLVESGGALVKPGGSLRLSCAASGFVFSKAWMSWVRQAPGKGLEWVGRIKSVTDGETTDYAAPVKGRFTISRDDSKSTLYLQMNSLKTEDTAVYYCTSSFCCRGKSCPSHDTSYCGGQYASYYYMDVWGKGTTVTVSS

SEQ ID NO: 1524 - protein, 140 aa, Artificial Sequence
  Description of Artificial Sequence: Synthetic polypeptide
EVQLVESGGALVKPGGSLRLSCAASGFTFAKAWMSWVRQAPGKGLEWVGRIKSVTDAETTDYAAPVKGRFTISRDDSKSTLYLQMNSLKTEDTAVYYCTSSFCCRSGSCPSSDTSYCNGQYKSYYWMDVWGKGTTVTVSS

SEQ ID NO: 1525 - protein, 140 aa, Artificial Sequence
  Description of Artificial Sequence: Synthetic polypeptide
EVQLVESGGALVKPGGSLRLSCAASGFTYAKAWFTWVRQAPGKGLEWVGRIKSTSDGGITDYAAPVKGRFTISRDDSKSTLYLQMNSLKTEDTAVYYCTSSFCCRGGSCPSHDTSFCGGQYKSYYYMDVWGKGTTVTVSS

SEQ ID NO: 1526 - protein, 140 aa, Artificial Sequence
  Description of Artificial Sequence: Synthetic polypeptide
EVQLVESGGALVKPGGSLRLSCAASGFTFSKAWMSWVRQAPGKGLEWVGRIKSVSDGETTDYAAPVKGRFTISRDDSKSTLYLQMNSLKTEDTAVYYCTSSFCCRGGSCPSRDTSYCGGQYKSYYFMDVWGKGTTVTVSS

SEQ ID NO: 1527 - protein, 110 aa, Artificial Sequence
  Description of Artificial Sequence: Synthetic polypeptide
QSVLTQAPSASETPGQRVIISCSGSSSNIGSSSVSWYQQLPGTAPKLLIYKNNQRPSGVPDRFSGSKSGTSASLAISGLRSEDEADYYCSTWDESLSVRVFGGGTKLTVL

SEQ ID NO: 1528 - protein, 110 aa, Artificial Sequence; identical to SEQ ID NO: 151
  Description of Artificial Sequence: Synthetic polypeptide

SEQ ID NO: 1529 - protein, 110 aa, Artificial Sequence; identical to SEQ ID NO: 151
  Description of Artificial Sequence: Synthetic polypeptide

SEQ ID NO: 1530 - protein, 110 aa, Artificial Sequence; identical to SEQ ID NO: 151
  Description of Artificial Sequence: Synthetic polypeptide

SEQ ID NO: 1531 - protein, 110 aa, Artificial Sequence; identical to SEQ ID NO: 123
  Description of Artificial Sequence: Synthetic polypeptide

SEQ ID NO: 1532 - protein, 110 aa, Artificial Sequence; identical to SEQ ID NO: 123
  Description of Artificial Sequence: Synthetic polypeptide

SEQ ID NO: 1533 - protein, 110 aa, Artificial Sequence; identical to SEQ ID NO: 123
  Description of Artificial Sequence: Synthetic polypeptide

SEQ ID NO: 1534 - protein, 110 aa, Artificial Sequence; identical to SEQ ID NO: 123
  Description of Artificial Sequence: Synthetic polypeptide

SEQ ID NO: 1535 - protein, 110 aa, Artificial Sequence; identical to SEQ ID NO: 123
  Description of Artificial Sequence: Synthetic polypeptide

SEQ ID NO: 1536 - protein, 110 aa, Artificial Sequence; identical to SEQ ID NO: 123
  Description of Artificial Sequence: Synthetic polypeptide

SEQ ID NO: 1537 - protein, 110 aa, Artificial Sequence; identical to SEQ ID NO: 123
  Description of Artificial Sequence: Synthetic polypeptide

SEQ ID NO: 1538 - protein, 110 aa, Artificial Sequence; identical to SEQ ID NO: 123
  Description of Artificial Sequence: Synthetic polypeptide

SEQ ID NO: 1539 - protein, 110 aa, Artificial Sequence; identical to SEQ ID NO: 123
  Description of Artificial Sequence: Synthetic polypeptide

SEQ ID NO: 1540 - protein, 110 aa, Artificial Sequence; identical to SEQ ID NO: 123
  Description of Artificial Sequence: Synthetic polypeptide

SEQ ID NO: 1541 - protein, 110 aa, Artificial Sequence; identical to SEQ ID NO: 123
  Description of Artificial Sequence: Synthetic polypeptide

SEQ ID NO: 1542 - protein, 110 aa, Artificial Sequence; identical to SEQ ID NO: 123
  Description of Artificial Sequence: Synthetic polypeptide

SEQ ID NO: 1543 - protein, 110 aa, Artificial Sequence; identical to SEQ ID NO: 123
  Description of Artificial Sequence: Synthetic polypeptide

SEQ ID NO: 1544 - protein, 110 aa, Artificial Sequence; identical to SEQ ID NO: 123
  Description of Artificial Sequence: Synthetic polypeptide

SEQ ID NO: 1545 - protein, 110 aa, Artificial Sequence; identical to SEQ ID NO: 123
  Description of Artificial Sequence: Synthetic polypeptide

SEQ ID NO: 1546 - protein, 110 aa, Artificial Sequence; identical to SEQ ID NO: 123
  Description of Artificial Sequence: Synthetic polypeptide

SEQ ID NO: 1547 - protein, 110 aa, Artificial Sequence; identical to SEQ ID NO: 123
  Description of Artificial Sequence: Synthetic polypeptide

SEQ ID NO: 1548 - protein, 110 aa, Artificial Sequence; identical to SEQ ID NO: 123
  Description of Artificial Sequence: Synthetic polypeptide

SEQ ID NO: 1549 - protein, 110 aa, Artificial Sequence; identical to SEQ ID NO: 123
  Description of Artificial Sequence: Synthetic polypeptide

SEQ ID NO: 1550 - protein, 110 aa, Artificial Sequence; identical to SEQ ID NO: 123
  Description of Artificial Sequence: Synthetic polypeptide

SEQ ID NO: 1551 - protein, 110 aa, Artificial Sequence; identical to SEQ ID NO: 123
  Description of Artificial Sequence: Synthetic polypeptide

SEQ ID NO: 1552 - protein, 110 aa, Artificial Sequence; identical to SEQ ID NO: 123
  Description of Artificial Sequence: Synthetic polypeptide

SEQ ID NO: 1553 - protein, 110 aa, Artificial Sequence; identical to SEQ ID NO: 123
  Description of Artificial Sequence: Synthetic polypeptide

SEQ ID NO: 1554 - protein, 110 aa, Artificial Sequence; identical to SEQ ID NO: 123
  Description of Artificial Sequence: Synthetic polypeptide

SEQ ID NO: 1555 - protein, 110 aa, Artificial Sequence; identical to SEQ ID NO: 123
  Description of Artificial Sequence: Synthetic polypeptide

SEQ ID NO: 1556 - protein, 110 aa, Artificial Sequence; identical to SEQ ID NO: 123
  Description of Artificial Sequence: Synthetic polypeptide

SEQ ID NO: 1557 - protein, 110 aa, Artificial Sequence; identical to SEQ ID NO: 123
  Description of Artificial Sequence: Synthetic polypeptide

SEQ ID NO: 1558 - protein, 110 aa, Artificial Sequence; identical to SEQ ID NO: 123
  Description of Artificial Sequence: Synthetic polypeptide

SEQ ID NO: 1559 - protein, 110 aa, Artificial Sequence; identical to SEQ ID NO: 123
  Description of Artificial Sequence: Synthetic polypeptide

SEQ ID NO: 1560 - protein, 110 aa, Artificial Sequence; identical to SEQ ID NO: 123
  Description of Artificial Sequence: Synthetic polypeptide

SEQ ID NO: 1561 - protein, 110 aa, Artificial Sequence; identical to SEQ ID NO: 123
  Description of Artificial Sequence: Synthetic polypeptide

SEQ ID NO: 1562 - protein, 110 aa, Artificial Sequence; identical to SEQ ID NO: 123
  Description of Artificial Sequence: Synthetic polypeptide

SEQ ID NO: 1563 - protein, 110 aa, Artificial Sequence; identical to SEQ ID NO: 123
  Description of Artificial Sequence: Synthetic polypeptide

SEQ ID NO: 1564 - protein, 110 aa, Artificial Sequence; identical to SEQ ID NO: 123
  Description of Artificial Sequence: Synthetic polypeptide

SEQ ID NO: 1565 - protein, 110 aa, Artificial Sequence; identical to SEQ ID NO: 123
  Description of Artificial Sequence: Synthetic polypeptide

SEQ ID NO: 1566 - protein, 110 aa, Artificial Sequence; identical to SEQ ID NO: 123
  Description of Artificial Sequence: Synthetic polypeptide

SEQ ID NO: 1567 - protein, 110 aa, Artificial Sequence; identical to SEQ ID NO: 123
  Description of Artificial Sequence: Synthetic polypeptide

SEQ ID NO: 1568 - protein, 110 aa, Artificial Sequence; identical to SEQ ID NO: 123
  Description of Artificial Sequence: Synthetic polypeptide

SEQ ID NO: 1569 - protein, 110 aa, Artificial Sequence; identical to SEQ ID NO: 123
  Description of Artificial Sequence: Synthetic polypeptide

SEQ ID NO: 1570 - protein, 110 aa, Artificial Sequence; identical to SEQ ID NO: 123
  Description of Artificial Sequence: Synthetic polypeptide

SEQ ID NO: 1571 - protein, 110 aa, Artificial Sequence; identical to SEQ ID NO: 123
  Description of Artificial Sequence: Synthetic polypeptide

SEQ ID NO: 1572 - protein, 110 aa, Artificial Sequence; identical to SEQ ID NO: 123
  Description of Artificial Sequence: Synthetic polypeptide

SEQ ID NO: 1573 - protein, 110 aa, Artificial Sequence; identical to SEQ ID NO: 123
  Description of Artificial Sequence: Synthetic polypeptide

SEQ ID NO: 1574 - protein, 110 aa, Artificial Sequence; identical to SEQ ID NO: 123
  Description of Artificial Sequence: Synthetic polypeptide

SEQ ID NO: 1575 - protein, 110 aa, Artificial Sequence; identical to SEQ ID NO: 123
  Description of Artificial Sequence: Synthetic polypeptide

SEQ ID NO: 1576 - protein, 110 aa, Artificial Sequence; identical to SEQ ID NO: 123
  Description of Artificial Sequence: Synthetic polypeptide

SEQ ID NO: 1577 - protein, 110 aa, Artificial Sequence; identical to SEQ ID NO: 123
  Description of Artificial Sequence: Synthetic polypeptide

SEQ ID NO: 1578 - protein, 110 aa, Artificial Sequence; identical to SEQ ID NO: 123
  Description of Artificial Sequence: Synthetic polypeptide

SEQ ID NO: 1579 - protein, 110 aa, Artificial Sequence; identical to SEQ ID NO: 123
  Description of Artificial Sequence: Synthetic polypeptide

SEQ ID NO: 1580 - protein, 110 aa, Artificial Sequence; identical to SEQ ID NO: 123
  Description of Artificial Sequence: Synthetic polypeptide

SEQ ID NO: 1581 - protein, 110 aa, Artificial Sequence; identical to SEQ ID NO: 123
  Description of Artificial Sequence: Synthetic polypeptide

SEQ ID NO: 1582 - protein, 110 aa, Artificial Sequence; identical to SEQ ID NO: 123
  Description of Artificial Sequence: Synthetic polypeptide

SEQ ID NO: 1583 - protein, 110 aa, Artificial Sequence; identical to SEQ ID NO: 123
  Description of Artificial Sequence: Synthetic polypeptide

SEQ ID NO: 1584 - protein, 110 aa, Artificial Sequence; identical to SEQ ID NO: 123
  Description of Artificial Sequence: Synthetic polypeptide

SEQ ID NO: 1585 - protein, 110 aa, Artificial Sequence; identical to SEQ ID NO: 123
  Description of Artificial Sequence: Synthetic polypeptide

SEQ ID NO: 1586 - protein, 110 aa, Artificial Sequence; identical to SEQ ID NO: 123
  Description of Artificial Sequence: Synthetic polypeptide

SEQ ID NO: 1587 - protein, 110 aa, Artificial Sequence; identical to SEQ ID NO: 123
  Description of Artificial Sequence: Synthetic polypeptide

SEQ ID NO: 1588 - protein, 110 aa, Artificial Sequence; identical to SEQ ID NO: 123
  Description of Artificial Sequence: Synthetic polypeptide

SEQ ID NO: 1589 - protein, 110 aa, Artificial Sequence; identical to SEQ ID NO: 123
  Description of Artificial Sequence: Synthetic polypeptide

SEQ ID NO: 1590 - protein, 110 aa, Artificial Sequence; identical to SEQ ID NO: 123
  Description of Artificial Sequence: Synthetic polypeptide

SEQ ID NO: 1591 - protein, 110 aa, Artificial Sequence; identical to SEQ ID NO: 123
  Description of Artificial Sequence: Synthetic polypeptide

SEQ ID NO: 1592 - protein, 110 aa, Artificial Sequence; identical to SEQ ID NO: 123
  Description of Artificial Sequence: Synthetic polypeptide

SEQ ID NO: 1593 - protein, 110 aa, Artificial Sequence; identical to SEQ ID NO: 123
  Description of Artificial Sequence: Synthetic polypeptide

SEQ ID NO: 1594 - protein, 110 aa, Artificial Sequence; identical to SEQ ID NO: 123
  Description of Artificial Sequence: Synthetic polypeptide

SEQ ID NO: 1595 - protein, 110 aa, Artificial Sequence; identical to SEQ ID NO: 123
  Description of Artificial Sequence: Synthetic polypeptide

SEQ ID NO: 1596 - protein, 110 aa, Artificial Sequence; identical to SEQ ID NO: 123
  Description of Artificial Sequence: Synthetic polypeptide

SEQ ID NO: 1597 - protein, 110 aa, Artificial Sequence; identical to SEQ ID NO: 123
  Description of Artificial Sequence: Synthetic polypeptide

SEQ ID NO: 1598 - protein, 110 aa, Artificial Sequence; identical to SEQ ID NO: 123
  Description of Artificial Sequence: Synthetic polypeptide

SEQ ID NO: 1599 - protein, 110 aa, Artificial Sequence; identical to SEQ ID NO: 123
  Description of Artificial Sequence: Synthetic polypeptide

SEQ ID NO: 1600 - protein, 110 aa, Artificial Sequence; identical to SEQ ID NO: 123
  Description of Artificial Sequence: Synthetic polypeptide

SEQ ID NO: 1601 - protein, 110 aa, Artificial Sequence; identical to SEQ ID NO: 123
  Description of Artificial Sequence: Synthetic polypeptide

SEQ ID NO: 1602 - protein, 110 aa, Artificial Sequence; identical to SEQ ID NO: 123
  Description of Artificial Sequence: Synthetic polypeptide

SEQ ID NO: 1603 - protein, 110 aa, Artificial Sequence; identical to SEQ ID NO: 123
  Description of Artificial Sequence: Synthetic polypeptide

SEQ ID NO: 1604 - protein, 110 aa, Artificial Sequence; identical to SEQ ID NO: 123
  Description of Artificial Sequence: Synthetic polypeptide

SEQ ID NO: 1605 - protein, 110 aa, Artificial Sequence; identical to SEQ ID NO: 123
  Description of Artificial Sequence: Synthetic polypeptide

SEQ ID NO: 1606 - protein, 110 aa, Artificial Sequence; identical to SEQ ID NO: 123
  Description of Artificial Sequence: Synthetic polypeptide

SEQ ID NO: 1607 - protein, 110 aa, Artificial Sequence; identical to SEQ ID NO: 123
  Description of Artificial Sequence: Synthetic polypeptide

SEQ ID NO: 1608 - protein, 110 aa, Artificial Sequence; identical to SEQ ID NO: 123
  Description of Artificial Sequence: Synthetic polypeptide

SEQ ID NO: 1609 - protein, 110 aa, Artificial Sequence; identical to SEQ ID NO: 123
  Description of Artificial Sequence: Synthetic polypeptide

SEQ ID NO: 1610 - protein, 110 aa, Artificial Sequence; identical to SEQ ID NO: 123
  Description of Artificial Sequence: Synthetic polypeptide

SEQ ID NO: 1611 - protein, 110 aa, Artificial Sequence; identical to SEQ ID NO: 123
  Description of Artificial Sequence: Synthetic polypeptide

SEQ ID NO: 1612 - protein, 110 aa, Artificial Sequence; identical to SEQ ID NO: 123
  Description of Artificial Sequence: Synthetic polypeptide

SEQ ID NO: 1613 - protein, 110 aa, Artificial Sequence
  Description of Artificial Sequence: Synthetic polypeptide
QSVLTQPPSASGTPGQRVTISCTGSSSNIGSSSVSWYQQLPGTAPKLLIYKNNQRPSGVPDRFSGSKSGTSASLAISGLRSEDEADYYCSTWDDSLSVRVFGGGTKLTVL

SEQ ID NO: 1614 - protein, 110 aa, Artificial Sequence
  Description of Artificial Sequence: Synthetic polypeptide
QSVLTQPPSASGTPGQRVTISCSGSSTNIGSSSVSWYQQLPGTAPKLLIYKNNYRPSGVPDRFSGSKSGTSASLAISGLRSEDEADYYCSTWDDSLSVRVFGGGTKLTVL

SEQ ID NO: 1615 - protein, 110 aa, Artificial Sequence; identical to SEQ ID NO: 123
  Description of Artificial Sequence: Synthetic polypeptide

SEQ ID NO: 1616 - protein, 110 aa, Artificial Sequence; identical to SEQ ID NO: 1613
  Description of Artificial Sequence: Synthetic polypeptide

SEQ ID NO: 1617 - protein, 110 aa, Artificial Sequence
  Description of Artificial Sequence: Synthetic polypeptide
QSVLTQPPSASGTPGQRVTISCSGASSNIGSSSVSWYQQLPGTAPKLLIYKNNQRPSGVPDRFSGSKSGTSASLAISGLRSEDEADYYCSTWDDSLSVRVFGGGTKLTVL

SEQ ID NO: 1618 - protein, 110 aa, Artificial Sequence
  Description of Artificial Sequence: Synthetic polypeptide
QSVLTQPPSASGTPGQRVTISCSGSPSNIGSSSVSWYQQLPGTAPKLLIYKNNQRPSGVPDRFSGSKSGTSASLAISGLRSEDEADYYCSTWDDSLSVRVFGGGTKLTVL

SEQ ID NO: 1619 - protein, 110 aa, Artificial Sequence
  Description of Artificial Sequence: Synthetic polypeptide
QSVLTQPPSASGTPGQRVTISCSGSKSNIGSSSVSWYQQLPGTAPKLLIYKNNQRPSGVPDRFSGSKSGTSASLAISGLRSEDEADYYCSTWDDSLSVRVFGGGTKLTVL

SEQ ID NO: 1620 - protein, 110 aa, Artificial Sequence
  Description of Artificial Sequence: Synthetic polypeptide
QSVLTQPPSASGTPGQRVTISCSGSSTNIGSSSVSWYQQLPGTAPKLLIYKNNQRPSGVPDRFSGSKSGTSASLAISGLRSEDEADYYCSTWDDSLSVRVFGGGTKLTVL

SEQ ID NO: 1621 - protein, 110 aa, Artificial Sequence
  Description of Artificial Sequence: Synthetic polypeptide
QSVLTQPPSASGTPGQRVTISCSGSSSDIGSSSVSWYQQLPGTAPKLLIYKNNQRPSGVPDRFSGSKSGTSASLAISGLRSEDEADYYCSTWDDSLSVRVFGGGTKLTVL

SEQ ID NO: 1622 - protein, 110 aa, Artificial Sequence
  Description of Artificial Sequence: Synthetic polypeptide
QSVLTQPPSASGTPGQRVTISCSGSSSNIQSSSVSWYQQLPGTAPKLLIYKNNQRPSGVPDRFSGSKSGTSASLAISGLRSEDEADYYCSTWDDSLSVRVFGGGTKLTVL

SEQ ID NO: 1623 - protein, 110 aa, Artificial Sequence
  Description of Artificial Sequence: Synthetic polypeptide
QSVLTQPPSASGTPGQRVTISCSGSSSNIGHSSVSWYQQLPGTAPKLLIYKNNQRPSGVPDRFSGSKSGTSASLAISGLRSEDEADYYCSTWDDSLSVRVFGGGTKLTVL

SEQ ID NO: 1624 - protein, 110 aa, Artificial Sequence
  Description of Artificial Sequence: Synthetic polypeptide
QSVLTQPPSASGTPGQRVTISCSGSSSNIGSTSVSWYQQLPGTAPKLLIYKNNQRPSGVPDRFSGSKSGTSASLAISGLRSEDEADYYCSTWDDSLSVRVFGGGTKLTVL

SEQ ID NO: 1625 - protein, 110 aa, Artificial Sequence
  Description of Artificial Sequence: Synthetic polypeptide
QSVLTQPPSASGTPGQRVTISCSGSSSNIGSNSVSWYQQLPGTAPKLLIYKNNQRPSGVPDRFSGSKSGTSASLAISGLRSEDEADYYCSTWDDSLSVRVFGGGTKLTVL

SEQ ID NO: 1626 - protein, 110 aa, Artificial Sequence
  Description of Artificial Sequence: Synthetic polypeptide
QSVLTQPPSASGTPGQRVTISCSGSSSNIGSASVSWYQQLPGTAPKLLIYKNNQRPSGVPDRFSGSKSGTSASLAISGLRSEDEADYYCSTWDDSLSVRVFGGGTKLTVL

SEQ ID NO: 1627 - protein, 110 aa, Artificial Sequence
  Description of Artificial Sequence: Synthetic polypeptide
QSVLTQPPSASGTPGQRVTISCSGSSSNIGSSTVSWYQQLPGTAPKLLIYKNNQRPSGVPDRFSGSKSGTSASLAISGLRSEDEADYYCSTWDDSLSVRVFGGGTKLTVL

SEQ ID NO: 1628 - protein, 110 aa, Artificial Sequence
  Description of Artificial Sequence: Synthetic polypeptide
QSVLTQPPSASGTPGQRVTISCSGSSSNIGSSAVSWYQQLPGTAPKLLIYKNNQRPSGVPDRFSGSKSGTSASLAISGLRSEDEADYYCSTWDDSLSVRVFGGGTKLTVL

SEQ ID NO: 1629 - protein, 110 aa, Artificial Sequence
  Description of Artificial Sequence: Synthetic polypeptide
QSVLTQPPSASGTPGQRVTISCSGSSSNIGSSYVSWYQQLPGTAPKLLIYKNNQRPSGVPDRFSGSKSGTSASLAISGLRSEDEADYYCSTWDDSLSVRVFGGGTKLTVL

SEQ ID NO: 1630 - protein, 110 aa, Artificial Sequence
  Description of Artificial Sequence: Synthetic polypeptide
QSVLTQPPSASGTPGQRVTISCSGSSSNIGSSSTSWYQQLPGTAPKLLIYKNNQRPSGVPDRFSGSKSGTSASLAISGLRSEDEADYYCSTWDDSLSVRVFGGGTKLTVL

SEQ ID NO: 1631 - protein, 110 aa, Artificial Sequence
  Description of Artificial Sequence: Synthetic polypeptide
QSVLTQPPSASGTPGQRVTISCSGSSSNIGSSSVAWYQQLPGTAPKLLIYKNNQRPSGVPDRFSGSKSGTSASLAISGLRSEDEADYYCSTWDDSLSVRVFGGGTKLTVL

SEQ ID NO: 1632 - protein, 110 aa, Artificial Sequence
  Description of Artificial Sequence: Synthetic polypeptide
QSVLTQPPSASGTPGQRVTISCSGSSSNIGSSSVTWYQQLPGTAPKLLIYKNNQRPSGVPDRFSGSKSGTSASLAISGLRSEDEADYYCSTWDDSLSVRVFGGGTKLTVL

SEQ ID NO: 1633 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYRNNQRPSGVPDRFSGSKSGTSASLAISGLRSEDEADYYCSTWDDSLSVRVFGGGTKLTVL

SEQ ID NO: 1634 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYNNNQRPSGVPDRFSGSKSGTSASLAISGLRSEDEADYYCSTWDDSLSVRVFGGGTKLTVL

SEQ ID NO: 1635 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYMNNQRPSGVPDRFSGSKSGTSASLAISGLRSEDEADYYCSTWDDSLSVRVFGGGTKLTVL

SEQ ID NO: 1636 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYANNQRPSGVPDRFSGSKSGTSASLAISGLRSEDEADYYCSTWDDSLSVRVFGGGTKLTVL

SEQ ID NO: 1637 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYHNNQRPSGVPDRFSGSKSGTSASLAISGLRSEDEADYYCSTWDDSLSVRVFGGGTKLTVL

SEQ ID NO: 1638 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKDNQRPSGVPDRFSGSKSGTSASLAISGLRSEDEADYYCSTWDDSLSVRVFGGGTKLTVL

SEQ ID NO: 1639 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNTQRPSGVPDRFSGSKSGTSASLAISGLRSEDEADYYCSTWDDSLSVRVFGGGTKLTVL

SEQ ID NO: 1640 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNYRPSGVPDRFSGSKSGTSASLAISGLRSEDEADYYCSTWDDSLSVRVFGGGTKLTVL

SEQ ID NO: 1641 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNARPSGVPDRFSGSKSGTSASLAISGLRSEDEADYYCSTWDDSLSVRVFGGGTKLTVL

SEQ ID NO: 1642 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNLRPSGVPDRFSGSKSGTSASLAISGLRSEDEADYYCSTWDDSLSVRVFGGGTKLTVL

SEQ ID NO: 1643 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQQPSGVPDRFSGSKSGTSASLAISGLRSEDEADYYCSTWDDSLSVRVFGGGTKLTVL

SEQ ID NO: 1644 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRASGVPDRFSGSKSGTSASLAISGLRSEDEADYYCSTWDDSLSVRVFGGGTKLTVL

SEQ ID NO: 1645 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPYGVPDRFSGSKSGTSASLAISGLRSEDEADYYCSTWDDSLSVRVFGGGTKLTVL

SEQ ID NO: 1646 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPLGVPDRFSGSKSGTSASLAISGLRSEDEADYYCSTWDDSLSVRVFGGGTKLTVL

SEQ ID NO: 1647 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCATWDDSLSVRVFGGGTKLTVL

SEQ ID NO: 1648 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSSWDDSLSVRVFGGGTKLTVL

SEQ ID NO: 1649 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTFDDSLSVRVFGGGTKLTVL

SEQ ID NO: 1650 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDNSLSVRVFGGGTKLTVL

SEQ ID NO: 1651 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDQLSVRVFGGGTKLTVL

SEQ ID NO: 1652 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDALSVRVFGGGTKLTVL

SEQ ID NO: 1653 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDDLSVRVFGGGTKLTVL

SEQ ID NO: 1654 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSNSVRVFGGGTKLTVL

SEQ ID NO: 1655 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSSSVRVFGGGTKLTVL

SEQ ID NO: 1656 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLNVRVFGGGTKLTVL

SEQ ID NO: 1657 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLLVRVFGGGTKLTVL

SEQ ID NO: 1658 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLTVRVFGGGTKLTVL

SEQ ID NO: 1659 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSIRVFGGGTKLTVL

SEQ ID NO: 1660 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVKVFGGGTKLTVL

SEQ ID NO: 1661 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVWVFGGGTKLTVL

SEQ ID NO: 1662 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVHVFGGGTKLTVL

SEQ ID NO: 1663 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVQVFGGGTKLTVL

SEQ ID NO: 1664 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRIFGGGTKLTVL

SEQ ID NO: 1665 - protein, 110 aa, Artificial Sequence
  Description of Artificial Sequence: Synthetic polypeptide
QSVLTQPPSASGTPGQRVTISCSGSSSDIGSSSVSWYQQLPGTAPKLLIYKNNQRPSGVPDRFSGSKSGTSASLAISGLRSEDEADYYCSTWNDQLSVRVFGGGTKLTVL

SEQ ID NO: 1666 - protein, 110 aa, Artificial Sequence
  Description of Artificial Sequence: Synthetic polypeptide
QSVLTQPPSASGTPGQRVTISCHGSESDIGSHDVLWYQQLPGTAPKLLIYKNNQRPSGVPDRFSGSKSGTSASLAISGLRSEDEADYYCSTWDDSLSVRVFGGGTKLTVL

SEQ ID NO: 1667 - protein, 110 aa, Artificial Sequence; identical to SEQ ID NO: 123
  Description of Artificial Sequence: Synthetic polypeptide

SEQ ID NO: 1668 - protein, 110 aa, Artificial Sequence; identical to SEQ ID NO: 123
  Description of Artificial Sequence: Synthetic polypeptide

SEQ ID NO: 1669 - protein, 110 aa, Artificial Sequence
  Description of Artificial Sequence: Synthetic polypeptide
QSVLTQPPSVSGAPGQRVTISCSGSSSNIGSSSVSWYQQLPGTAPKLLIYKNNQRPSGVPDRFSGSKSGTSASLAITGLQAEDEADYYCSTWDDSLSVRVFGGGTKLTVL

SEQ ID NO: 1670 - protein, 110 aa, Artificial Sequence; identical to SEQ ID NO: 1669
  Description of Artificial Sequence: Synthetic polypeptide

SEQ ID NO: 1671 - protein, 110 aa, Artificial Sequence; identical to SEQ ID NO: 123
  Description of Artificial Sequence: Synthetic polypeptide

SEQ ID NO: 1672 - protein, 110 aa, Artificial Sequence; identical to SEQ ID NO: 123
  Description of Artificial Sequence: Synthetic polypeptide

SEQ ID NO: 1673 - protein, 110 aa, Artificial Sequence; identical to SEQ ID NO: 123
  Description of Artificial Sequence: Synthetic polypeptide

SEQ ID NO: 1674 - protein, 110 aa, Artificial Sequence; identical to SEQ ID NO: 123
  Description of Artificial Sequence: Synthetic polypeptide

SEQ ID NO: 1675 - protein, 110 aa, Artificial Sequence; identical to SEQ ID NO: 123
  Description of Artificial Sequence: Synthetic polypeptide

SEQ ID NO: 1676 - protein, 110 aa, Artificial Sequence; identical to SEQ ID NO: 123
  Description of Artificial Sequence: Synthetic polypeptide

SEQ ID NO: 1677 - protein, 110 aa, Artificial Sequence; identical to SEQ ID NO: 123
  Description of Artificial Sequence: Synthetic polypeptide

SEQ ID NO: 1678 - protein, 110 aa, Artificial Sequence; identical to SEQ ID NO: 123
  Description of Artificial Sequence: Synthetic polypeptide

SEQ ID NO: 1679 - protein, 110 aa, Artificial Sequence; identical to SEQ ID NO: 123
  Description of Artificial Sequence: Synthetic polypeptide

SEQ ID NO: 1680 - protein, 110 aa, Artificial Sequence; identical to SEQ ID NO: 123
  Description of Artificial Sequence: Synthetic polypeptide

SEQ ID NO: 1681 - protein, 110 aa, Artificial Sequence; identical to SEQ ID NO: 123
  Description of Artificial Sequence: Synthetic polypeptide

SEQ ID NO: 1682 - protein, 110 aa, Artificial Sequence; identical to SEQ ID NO: 123
  Description of Artificial Sequence: Synthetic polypeptide

SEQ ID NO: 1683 - protein, 110 aa, Artificial Sequence; identical to SEQ ID NO: 123
  Description of Artificial Sequence: Synthetic polypeptide

SEQ ID NO: 1684 - protein, 110 aa, Artificial Sequence; identical to SEQ ID NO: 123
  Description of Artificial Sequence: Synthetic polypeptide

SEQ ID NO: 1685 - protein, 110 aa, Artificial Sequence; identical to SEQ ID NO: 123
  Description of Artificial Sequence: Synthetic polypeptide

SEQ ID NO: 1686 - protein, 110 aa, Artificial Sequence; identical to SEQ ID NO: 123
  Description of Artificial Sequence: Synthetic polypeptide

SEQ ID NO: 1687 - protein, 110 aa, Artificial Sequence; identical to SEQ ID NO: 123
  Description of Artificial Sequence: Synthetic polypeptide

SEQ ID NO: 1688 - protein, 110 aa, Artificial Sequence; identical to SEQ ID NO: 123
  Description of Artificial Sequence: Synthetic polypeptide

SEQ ID NO: 1689 - protein, 110 aa, Artificial Sequence; identical to SEQ ID NO: 123
  Description of Artificial Sequence: Synthetic polypeptide

SEQ ID NO: 1690 - protein, 110 aa, Artificial Sequence; identical to SEQ ID NO: 123
  Description of Artificial Sequence: Synthetic polypeptide

SEQ ID NO: 1691 - protein, 110 aa, Artificial Sequence; identical to SEQ ID NO: 123
  Description of Artificial Sequence: Synthetic polypeptide

SEQ ID NO: 1692 - protein, 110 aa, Artificial Sequence; identical to SEQ ID NO: 123
  Description of Artificial Sequence: Synthetic polypeptide

SEQ ID NO: 1693 - protein, 110 aa, Artificial Sequence; identical to SEQ ID NO: 123
  Description of Artificial Sequence: Synthetic polypeptide

SEQ ID NO: 1694 - protein, 110 aa, Artificial Sequence; identical to SEQ ID NO: 123
  Description of Artificial Sequence: Synthetic polypeptide

SEQ ID NO: 1695 - protein, 110 aa, Artificial Sequence; identical to SEQ ID NO: 123
  Description of Artificial Sequence: Synthetic polypeptide

SEQ ID NO: 1696 - protein, 110 aa, Artificial Sequence; identical to SEQ ID NO: 123
  Description of Artificial Sequence: Synthetic polypeptide

SEQ ID NO: 1697 - protein, 110 aa, Artificial Sequence; identical to SEQ ID NO: 123
  Description of Artificial Sequence: Synthetic polypeptide

SEQ ID NO: 1698 - protein, 110 aa, Artificial Sequence; identical to SEQ ID NO: 123
  Description of Artificial Sequence: Synthetic polypeptide

SEQ ID NO: 1699 - protein, 110 aa, Artificial Sequence; identical to SEQ ID NO: 123
  Description of Artificial Sequence: Synthetic polypeptide

SEQ ID NO: 1700 - protein, 110 aa, Artificial Sequence; identical to SEQ ID NO: 123
  Description of Artificial Sequence: Synthetic polypeptide

SEQ ID NO: 1701 - protein, 110 aa, Artificial Sequence; identical to SEQ ID NO: 123
  Description of Artificial Sequence: Synthetic polypeptide

SEQ ID NO: 1702 - protein, 110 aa, Artificial Sequence; identical to SEQ ID NO: 123
  Description of Artificial Sequence: Synthetic polypeptide

SEQ ID NO: 1703 - protein, 110 aa, Artificial Sequence; identical to SEQ ID NO: 123
  Description of Artificial Sequence: Synthetic polypeptide

SEQ ID NO: 1704 - protein, 110 aa, Artificial Sequence
  Description of Artificial Sequence: Synthetic polypeptide
QSVLTQPPSASGTPGQRVTISCSGSSTNIGSSSVYWYQQLPGTAPKLLIYKNNYRPSGVPDRFSGSKSGTSASLAISGLRSEDEADYYCSTWDDSLSVRVFGGGTKLTVL

SEQ ID NO: 1705 - protein, 110 aa, Artificial Sequence
  Description of Artificial Sequence: Synthetic polypeptide
QSVLTQPPSASGTPGQRVTISCSGSSTNIGSSSVYWYQQLPGTAPKLLIYKNNYRASGVPDRFSGSKSGTSASLAISGLRSEDEADYYCSTWDDSLSVRVFGGGTKLTVL

SEQ ID NO: 1706 - protein, 110 aa, Artificial Sequence
  Description of Artificial Sequence: Synthetic polypeptide
QSVLTQPPSASGTPGQRVTISCTGSSSNIGSSYVSWYQQLPGTAPKLLIYKNSLRPQGVPDRFSGSKSGTSASLAISGLRSEDEADYYCSTWDDSLSVRVFGGGTKLTVL

SEQ ID NO: 1707 - protein, 110 aa, Artificial Sequence; identical to SEQ ID NO: 1706
  Description of Artificial Sequence: Synthetic polypeptide

SEQ ID NO: 1708 - protein, 110 aa, Artificial Sequence; identical to SEQ ID NO: 1706
  Description of Artificial Sequence: Synthetic polypeptide

SEQ ID NO: 1709 - protein, 110 aa, Artificial Sequence; identical to SEQ ID NO: 1706
  Description of Artificial Sequence: Synthetic polypeptide

SEQ ID NO: 1710 - protein, 110 aa, Artificial Sequence
  Description of Artificial Sequence: Synthetic polypeptide
QSVLTQPPSASGTPGQRVTISCSGSPSNIGSASTSWYQQLPGTAPKLLIYKNNQRPSGVPDRFSGSKSGTSASLAISGLRSEDEADYYCSTWDDSLSVRVFGGGTKLTVL

SEQ ID NO: 1711 - protein, 110 aa, Artificial Sequence; identical to SEQ ID NO: 1710
  Description of Artificial Sequence: Synthetic polypeptide

SEQ ID NO: 1712 - protein, 110 aa, Artificial Sequence; identical to SEQ ID NO: 1710
  Description of Artificial Sequence: Synthetic polypeptide

SEQ ID NO: 1713 - protein, 110 aa, Artificial Sequence; identical to SEQ ID NO: 1710
  Description of Artificial Sequence: Synthetic polypeptide

SEQ ID NO: 1714 - protein, 110 aa, Artificial Sequence; identical to SEQ ID NO: 1710
  Description of Artificial Sequence: Synthetic polypeptide

SEQ ID NO: 1715 - protein, 110 aa, Artificial Sequence
  Description of Artificial Sequence: Synthetic polypeptide
QSVLTQPPSASGTPGQRVTISCSGASSNIGHSSVYWYQQLPGTAPKLLIYRNNQQPLGVPDRFSGSKSGTSASLAISGLRSEDEADYYCSTWDDALSIRVFGGGTKLTVL

SEQ ID NO: 1716 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYKNTQRASGVPDRFSGSKSGTSASLAISGLRSEDEADYYCSTWDDALNVRVFGGGTKLTVL

SEQ ID NO: 1717 - protein, 110 aa, Artificial Sequence
  Description of Artificial Sequence: Synthetic polypeptide
QSVLTQPPSASGTPGQRVTISCSGSSSNIGSSSVSWYQQLPGTAPKLLIYRNNQQPLGVPDRFSGSKSGTSASLAISGLRSEDEADYYCSSWDDSSLVRVFGGGTKLTVL

SEQ ID NO: 1718 - protein, 110 aa, Artificial Sequence
  Description of Artificial Sequence: Synthetic polypeptide
QSVLTQPPSASGTPGQRVTISCSGSSSNIGSSSVTWYQQLPGTAPKLLIYKNNARPSGVPDRFSGSKSGTSASLAISGLRSEDEADYYCATWDNSLSIRVFGGGTKLTVL

SEQ ID NO: 1719 - protein, 110 aa, Artificial Sequence
  Description of Artificial Sequence: Synthetic polypeptide
QSVLTQPPSASGTPGQRVTISCSGSKSNIGSSYVSWYQQLPGTAPKLLIYKDNQRASGVPDRFSGSKSGTSASLAISGLRSEDEADYYCSTWDDALSVRVFGGGTKLTVL

SEQ ID NO: 1720 - protein, 110 aa, Artificial Sequence; identical to SEQ ID NO: 158
  Description of Artificial Sequence: Synthetic polypeptide

SEQ ID NO: 1721 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1722 - protein, 106 aa, Artificial Sequence
  Description of Artificial Sequence: Synthetic polypeptide
GQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 1723 - protein, 469 aa, Artificial Sequence
  Description of Artificial Sequence: Synthetic polypeptide
EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1724 - protein, 216 aa, Artificial Sequence
  Description of Artificial Sequence: Synthetic polypeptide
QSVLTQPPSASGTPGQRVTISCSGSSSNIGSSSVSWYQQLPGTAPKLLIYKNNQRPSGVPDRFSGSKSGTSASLAISGLRSEDEADYYCSTWDDSLSVRVFGGGTKLTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 1725 - protein, 140 aa, Artificial Sequence; identical to SEQ ID NO: 99
  Description of Artificial Sequence: Synthetic polypeptide

SEQ ID NO: 1726 - protein, 110 aa, Artificial Sequence; identical to SEQ ID NO: 123
  Description of Artificial Sequence: Synthetic polypeptide

SEQ ID NO: 1727 - protein, 31 aa, Artificial Sequence; identical to SEQ ID NO: 38
  Description of Artificial Sequence: Synthetic polypeptide

SEQ ID NO: 1728 - protein, 10 aa, Artificial Sequence
  Description of Artificial Sequence: Synthetic peptide
  MOD_RES (3)..(3): T or V
  MOD_RES (4)..(4): F or Y
  MOD_RES (5)..(5): S or A
  MOD_RES (6)..(6): K, A or M
  MOD_RES (10)..(10): S or T
GFXXXXAWMX

SEQ ID NO: 1729 - protein, 19 aa, Artificial Sequence
  Description of Artificial Sequence: Synthetic peptide
  MOD_RES (4)..(4): S or A
  MOD_RES (5)..(5): V, N, A or T
  MOD_RES (6)..(6): T, Q, S, D or H
  MOD_RES (7)..(7): D or E
  MOD_RES (8)..(8): G or A
  MOD_RES (9)..(9): E, H, K or G
  MOD_RES (10)..(10): T, Q or I
  MOD_RES (12)..(12): D or E
  MOD_RES (16)..(16): P or S
RIKXXXXXXXTXYAAXVKG

SEQ ID NO: 1730 - protein, 31 aa, Artificial Sequence
  Description of Artificial Sequence: Synthetic polypeptide
  MOD_RES (1)..(1): I or T
  MOD_RES (2)..(2): S or T
  MOD_RES (7)..(7): H or R
  MOD_RES (8)..(8): G or S
  MOD_RES (9)..(9): A, G, K or N
  MOD_RES (10)..(10): N, Q, R or S
  MOD_RES (14)..(14): H, R or S
  MOD_RES (15)..(15): D or E
  MOD_RES (18)..(18): F or Y
  MOD_RES (20)..(20): A, G or N
  MOD_RES (21)..(21): G or N
  MOD_RES (22)..(22): Q, S or Y
  MOD_RES (23)..(23): D, F, N or Y
  MOD_RES (24)..(24): A, K, N, P or S
  MOD_RES (25)..(25): D, Q, R or S
  MOD_RES (26)..(26): F or Y
  MOD_RES (28)..(28): F or Y
  MOD_RES (29)..(29): M or V
  MOD_RES (30)..(30): D or N
  MOD_RES (31)..(31): I, P or V
XXSFCCXXXXCPSXXTSXCXXXXXXXYXXXX

SEQ ID NO: 1731 - protein, 13 aa, Artificial Sequence
  Description of Artificial Sequence: Synthetic peptide
  MOD_RES (3)..(3): S or A
  MOD_RES (4)..(4): S, P or K
  MOD_RES (5)..(5): S or T
  MOD_RES (6)..(6): N or D
  MOD_RES (11)..(11): S, Y or T
  MOD_RES (13)..(13): S, Y or T
SGXXXXIGSSXVX

SEQ ID NO: 1732 - protein, 7 aa, Artificial Sequence
  Description of Artificial Sequence: Synthetic peptide
  MOD_RES (1)..(1): K or M
  MOD_RES (2)..(2): N or D
  MOD_RES (3)..(3): S, N or T
  MOD_RES (4)..(4): L, Q or A
  MOD_RES (6)..(6): P or A
  MOD_RES (7)..(7): Q, S, Y or L
XXXXRXX

SEQ ID NO: 1733 - protein, 11 aa, Artificial Sequence
  Description of Artificial Sequence: Synthetic peptide
  MOD_RES (1)..(1): A or S
  MOD_RES (2)..(2): S or T
  MOD_RES (4)..(4): D or N
  MOD_RES (5)..(5): E, D or N
  MOD_RES (6)..(6): S, A or Q
  MOD_RES (7)..(7): L or N
  MOD_RES (8)..(8): N, S or T
  MOD_RES (9)..(9): I or V
  MOD_RES (11)..(11): I or V
XXWXXXXXXRX

SEQ ID NO: 1734 - protein, 10 aa, Artificial Sequence
  Description of Artificial Sequence: Synthetic peptide
  MOD_RES (2)..(2): F or Y
  MOD_RES (3)..(3): D, T or V
  MOD_RES (4)..(4): A, F or Y
  MOD_RES (5)..(5): A or S
  MOD_RES (6)..(6): A, H, K, M, N or R
  MOD_RES (8)..(8): W or Y
  MOD_RES (9)..(9): F, M or Y
  MOD_RES (10)..(10): S or T
GXXXXXAXXX

SEQ ID NO: 1735 - protein, 15 aa, Artificial Sequence
  Description of Artificial Sequence: Synthetic peptide
  MOD_RES (1)..(1): F or R
  MOD_RES (3)..(3): K or Q
  MOD_RES (4)..(4): A or S
  MOD_RES (5)..(5): A, N, T or V
  MOD_RES (6)..(6): D, H, Q, S or T
  MOD_RES (7)..(7): D, E or N
  MOD_RES (8)..(8): A or G
  MOD_RES (9)..(9): E, G, H, K or Q
  MOD_RES (10)..(10): A, I, Q or T
  MOD_RES (12)..(12): D or E
  MOD_RES (13)..(13): A or S
  MOD_RES (14)..(14): P or S
  MOD_RES (15)..(15): K or Q
XIXXXXXXXXTXXXX

SEQ ID NO: 1736 - protein, 31 aa, Artificial Sequence
  Description of Artificial Sequence: Synthetic polypeptide
  MOD_RES (1)..(1): I or T
  MOD_RES (2)..(2): S or T
  MOD_RES (3)..(3): A, P, S or T
  MOD_RES (4)..(4): F or Y
  MOD_RES (5)..(5): A, C or S
  MOD_RES (7)..(7): H, L, Q or R
  MOD_RES (8)..(8): G or S
  MOD_RES (9)..(9): A, G, K or N
  MOD_RES (10)..(10): A, N, Q, R or S
  MOD_RES (12)..(12): A, L or P
  MOD_RES (13)..(13): A, N or S
  MOD_RES (14)..(14): H, Q, R or S
  MOD_RES (15)..(15): D or E
  MOD_RES (16)..(16): N, Q or T
  MOD_RES (18)..(18): F, M or Y
  MOD_RES (19)..(19): C, S or V
  MOD_RES (20)..(20): A, G or N
  MOD_RES (21)..(21): A, G or N
  MOD_RES (22)..(22): Q, S or Y
  MOD_RES (23)..(23): D, F, N, S or Y
  MOD_RES (24)..(24): A, K, N, P, Q or S
  MOD_RES (25)..(25): D, K, Q, R or S
  MOD_RES (26)..(26): F or Y
  MOD_RES (27)..(27): F or Y
  MOD_RES (28)..(28): F, L, W or Y
  MOD_RES (29)..(29): F, M or V
  MOD_RES (30)..(30): D or N
  MOD_RES (31)..(31): I, P or V
XXXXXCXXXXCXXXXXSXXXXXXXXXXXXXX

SEQ ID NO: 1737 - protein, 13 aa, Artificial Sequence
  Description of Artificial Sequence: Synthetic peptide
  MOD_RES (1)..(1): H, S or T
  MOD_RES (3)..(3): A or S
  MOD_RES (4)..(4): E, K, P or S
  MOD_RES (5)..(5): S or T
  MOD_RES (6)..(6): D or N
  MOD_RES (8)..(8): G or Q
  MOD_RES (9)..(9): H or S
  MOD_RES (10)..(10): A, H, N, S or T
  MOD_RES (11)..(11): A, D, S, T or Y
  MOD_RES (12)..(12): T or V
  MOD_RES (13)..(13): A, L, S, T or Y
XGXXXXIXXXXXX

SEQ ID NO: 1738 - protein, 7 aa, Artificial Sequence
  Description of Artificial Sequence: Synthetic peptide
  MOD_RES (1)..(1): A, H, K, M, N or R
  MOD_RES (2)..(2): D or N
  MOD_RES (3)..(3): N, S or T
  MOD_RES (4)..(4): A, L, Q or Y
  MOD_RES (5)..(5): Q or R
  MOD_RES (6)..(6): A or P
  MOD_RES (7)..(7): L, Q, S or Y
XXXXXXX

SEQ ID NO: 1739 - protein, 11 aa, Artificial Sequence
  Description of Artificial Sequence: Synthetic peptide
  MOD_RES (1)..(1): A or S
  MOD_RES (2)..(2): S or T
  MOD_RES (3)..(3): F or W
  MOD_RES (4)..(4): D or N
  MOD_RES (5)..(5): D, E or N
  MOD_RES (6)..(6): A, D, Q or S
  MOD_RES (7)..(7): L, N or S
  MOD_RES (8)..(8): L, N, S or T
  MOD_RES (9)..(9): I or V
  MOD_RES (10)..(10): H, K, Q, R or W
  MOD_RES (11)..(11): I or V
XXXXXXXXXXX

SEQ ID NO: 1740 - protein, 31 aa, Artificial Sequence
  Description of Artificial Sequence: Synthetic polypeptide
TSSFCCRGGRCPSRDTSFCGGQYNSYYYMDV

SEQ ID NO: 1741 - protein, 13 aa, Artificial Sequence
  Description of Artificial Sequence: Synthetic peptide
SGSSDNIGSSSVS

SEQ ID NO: 1742 - protein, 10 aa, Artificial Sequence
  Description of Artificial Sequence: Synthetic peptide
  MOD_RES (2)..(2): F or Y
  MOD_RES (3)..(3): D, T or V
  MOD_RES (4)..(4): A, F or Y
  MOD_RES (5)..(5): A or S
  MOD_RES (6)..(6): A, H, K, M or N
  MOD_RES (8)..(8): W or Y
  MOD_RES (9)..(9): F or M
  MOD_RES (10)..(10): S or T
GXXXXXAXXX

SEQ ID NO: 1743 - protein, 14 aa, Artificial Sequence
  Description of Artificial Sequence: Synthetic peptide
  MOD_RES (4)..(4): A or S
  MOD_RES (5)..(5): A, N, T or V
  MOD_RES (6)..(6): D, H, Q, S or T
  MOD_RES (7)..(7): D or N
  MOD_RES (8)..(8): A or G
  MOD_RES (9)..(9): E, G, H, K or Q
  MOD_RES (10)..(10): A, I, Q or T
  MOD_RES (11)..(11): D or E
  MOD_RES (12)..(12): A or S
  MOD_RES (13)..(13): P or S
  MOD_RES (14)..(14): K or Q
RIKXXXXXXXXXXX

SEQ ID NO: 1744 - protein, 31 aa, Artificial Sequence
  Description of Artificial Sequence: Synthetic polypeptide
  MOD_RES (1)..(1): I or T
  MOD_RES (2)..(2): S or T
  MOD_RES (3)..(3): A, P or S
  MOD_RES (4)..(4): F or Y
  MOD_RES (7)..(7): H, L, Q or R
  MOD_RES (8)..(8): G or S
  MOD_RES (9)..(9): A, G, K or N
  MOD_RES (10)..(10): A, N, Q, R or S
  MOD_RES (12)..(12): A, L or P
  MOD_RES (13)..(13): N or S
  MOD_RES (14)..(14): H, Q, R or S
  MOD_RES (15)..(15): D or E
  MOD_RES (18)..(18): F or Y
  MOD_RES (20)..(20): A, G or N
  MOD_RES (21)..(21): G or N
  MOD_RES (22)..(22): Q, S or Y
  MOD_RES (23)..(23): D, F, N or Y
  MOD_RES (24)..(24): A, K, N, P or Q
  MOD_RES (25)..(25): D, Q, R or S
  MOD_RES (26)..(26): F or Y
  MOD_RES (28)..(28): F, L, W or Y
  MOD_RES (29)..(29): F, M or V
  MOD_RES (30)..(30): D or N
  MOD_RES (31)..(31): I, P or V
XXXXCCXXXXCXXXXTSXCXXXXXXXYXXXX

SEQ ID NO: 1745 - protein, 13 aa, Artificial Sequence
  Description of Artificial Sequence: Synthetic peptide
  MOD_RES (1)..(1): S or T
  MOD_RES (3)..(3): A or S
  MOD_RES (4)..(4): K, P or S
  MOD_RES (5)..(5): S or T
  MOD_RES (6)..(6): D or N
  MOD_RES (9)..(9): H or S
  MOD_RES (10)..(10): A, N, S or T
  MOD_RES (11)..(11): A, S, T or Y
  MOD_RES (12)..(12): T or V
  MOD_RES (13)..(13): A, S, T or Y
XGXXXXIGXXXXX

SEQ ID NO: 1746 - protein, 11 aa, Artificial Sequence
  Description of Artificial Sequence: Synthetic peptide
  MOD_RES (1)..(1): A or S
  MOD_RES (2)..(2): S or T
  MOD_RES (4)..(4): D or N
  MOD_RES (5)..(5): D, E or N
  MOD_RES (6)..(6): A, D, Q or S
  MOD_RES (7)..(7): L, N or S
  MOD_RES (8)..(8): L, N, S or T
  MOD_RES (9)..(9): I or V
  MOD_RES (10)..(10): H, K, Q or R
  MOD_RES (11)..(11): I or V
XXWXXXXXXXX

SEQ ID NO: 1747 - protein, 31 aa, Artificial Sequence
  Description of Artificial Sequence: Synthetic polypeptide
  MOD_RES (2)..(2): S or T
  MOD_RES (10)..(10): R or S
  MOD_RES (14)..(14): H or R
  MOD_RES (18)..(18): Y or F
  MOD_RES (22)..(22): Q or S
  MOD_RES (23)..(23): Y or D
  MOD_RES (24)..(24): K, N or S
  MOD_RES (25)..(25): R or S
TXSFCCRGGXCPSXDTSXCGGXXXXYYYMDV

SEQ ID NO: 1748 - protein, 12 aa, Artificial Sequence
  Description of Artificial Sequence: Synthetic peptide
  MOD_RES (5)..(5): D or E
STWDXDSLSVRV

SEQ ID NO: 1749 - protein, 10 aa, Artificial Sequence
  Description of Artificial Sequence: Synthetic peptide
  MOD_RES (10)..(10): S or T
GFTFSKAWMX

SEQ ID NO: 1750 - protein, 19 aa, Artificial Sequence
  Description of Artificial Sequence: Synthetic peptide
  MOD_RES (5)..(5): V or T
  MOD_RES (6)..(6): T or S
  MOD_RES (7)..(7): D or E
  MOD_RES (9)..(9): E or G
  MOD_RES (10)..(10): I or T
RIKSXXXGXXTDYAAPVKG

SEQ ID NO: 1751 - protein, 31 aa, Artificial Sequence
  Description of Artificial Sequence: Synthetic polypeptide
  MOD_RES (2)..(2): S or T
  MOD_RES (10)..(10): R or S
  MOD_RES (14)..(14): H or R
  MOD_RES (18)..(18): Y or F
  MOD_RES (22)..(22): Q or S
TXSFCCRGGXCPSXDTSXCGGXYKSYYYMDV

SEQ ID NO: 1752 - protein, 31 aa, Artificial Sequence
  Description of Artificial Sequence: Synthetic polypeptide
  MOD_RES (2)..(2): S or T
  MOD_RES (10)..(10): R or S
  MOD_RES (14)..(14): H or R
  MOD_RES (18)..(18): Y or F
  MOD_RES (22)..(22): Q or S
TXSFCCRGGXCPSXDTSXCGGXDSRYYYMDV

SEQ ID NO: 1753 - protein, 31 aa, Artificial Sequence
  Description of Artificial Sequence: Synthetic polypeptide
  MOD_RES (2)..(2): S or T
  MOD_RES (10)..(10): R or S
  MOD_RES (14)..(14): H or R
  MOD_RES (18)..(18): Y or F
  MOD_RES (22)..(22): Q or S
TXSFCCRGGXCPSXDTSXCGGXYNRYYYMDV

SEQ ID NO: 1754 - protein, 31 aa, Artificial Sequence
  Description of Artificial Sequence: Synthetic polypeptide
  MOD_RES (2)..(2): S or T
  MOD_RES (10)..(10): R or S
  MOD_RES (14)..(14): H or R
  MOD_RES (18)..(18): Y or F
  MOD_RES (22)..(22): Q or S
TXSFCCRGGXCPSXDTSXCGGXYNSYYYMDV

SEQ ID NO: 1755 - protein, 31 aa, Artificial Sequence
  Description of Artificial Sequence: Synthetic polypeptide
  MOD_RES (2)..(2): S or T
  MOD_RES (10)..(10): R or S
  MOD_RES (14)..(14): H or R
  MOD_RES (18)..(18): Y or F
  MOD_RES (22)..(22): Q or S
TXSFCCRGGXCPSXDTSXCGGXDKRYYYMDV

SEQ ID NO: 1756 - protein, 19 aa, Artificial Sequence
  Description of Artificial Sequence: Synthetic peptide
  MOD_RES (7)..(7): D or E
RIKSVTXGETTDYAAPVKG

SEQ ID NO: 1757 - protein, 31 aa, Artificial Sequence
  Description of Artificial Sequence: Synthetic polypeptide
  MOD_RES (2)..(2): S or T
  MOD_RES (18)..(18): Y or F
  MOD_RES (22)..(22): Q or S
  MOD_RES (23)..(23): Y or D
  MOD_RES (24)..(24): K, N or S
  MOD_RES (25)..(25): R or S
TXSFCCRGGSCPSHDTSXCGGXXXXYYYMDV

SEQ ID NO: 1758 - protein, 31 aa, Artificial Sequence
  Description of Artificial Sequence: Synthetic polypeptide
  MOD_RES (2)..(2): S or T
  MOD_RES (18)..(18): Y or F
  MOD_RES (22)..(22): Q or S
TXSFCCRGGSCPSHDTSXCGGXYKSYYYMDV

SEQ ID NO: 1759 - protein, 31 aa, Artificial Sequence
  Description of Artificial Sequence: Synthetic polypeptide
  MOD_RES (2)..(2): S or T
  MOD_RES (18)..(18): Y or F
  MOD_RES (22)..(22): Q or S
TXSFCCRGGSCPSHDTSXCGGXDSRYYYMDV

SEQ ID NO: 1760 - protein, 31 aa, Artificial Sequence
  Description of Artificial Sequence: Synthetic polypeptide
  MOD_RES (2)..(2): S or T
  MOD_RES (18)..(18): Y or F
  MOD_RES (22)..(22): Q or S
TXSFCCRGGSCPSHDTSXCGGXYNRYYYMDV

SEQ ID NO: 1761 - protein, 31 aa, Artificial Sequence
  Description of Artificial Sequence: Synthetic polypeptide
  MOD_RES (2)..(2): S or T
  MOD_RES (18)..(18): Y or F
  MOD_RES (22)..(22): Q or S
TXSFCCRGGSCPSHDTSXCGGXDKRYYYMDV

SEQ ID NO: 1762 - protein, 11 aa, Artificial Sequence
  Description of Artificial Sequence: Synthetic peptide
  MOD_RES (5)..(5): D or E
STWDXSLSVRV

SEQ ID NO: 1763 - protein, 8 aa, Artificial Sequence
  Description of Artificial Sequence: Synthetic peptide
GFTFSKAW

SEQ ID NO: 1764 - protein, 10 aa, Artificial Sequence
  Description of Artificial Sequence: Synthetic peptide
IKSVTDGETT

SEQ ID NO: 1765 - protein, 8 aa, Artificial Sequence
  Description of Artificial Sequence: Synthetic peptide
SSNIGSSS

SEQ ID NO: 1766 - protein, 5 aa, Artificial Sequence
  Description of Artificial Sequence: Synthetic peptide
KAWMS

SEQ ID NO: 1767 - protein, 29 aa, Artificial Sequence
  Description of Artificial Sequence: Synthetic peptide
SFCCRGGSCPSHDTSYCGGQYKSYYYMDV

SEQ ID NO: 1768 - protein, 7 aa, Artificial Sequence
  Description of Artificial Sequence: Synthetic peptide
GFTFSKA

SEQ ID NO: 1769 - protein, 8 aa, Artificial Sequence
  Description of Artificial Sequence: Synthetic peptide
KSVTDGET

SEQ ID NO: 1770 - protein, 19 aa, Artificial Sequence
  Description of Artificial Sequence: Synthetic peptide
  MOD_RES (5)..(5): V or T
  MOD_RES (6)..(6): T or S
  MOD_RES (7)..(7): D or E
  MOD_RES (9)..(9): E or G
  MOD_RES (10)..(10): I or T
  MOD_RES (12)..(12): D or E
RIKSXXXGXXTXYAAPVKG

SEQ ID NO: 1771 - protein, 7 aa, Artificial Sequence
  Description of Artificial Sequence: Synthetic peptide
  MOD_RES (1)..(1): K or R
  MOD_RES (2)..(2): N or D
  MOD_RES (3)..(3): N or D
XXXQRPS

SEQ ID NO: 1772 - protein, 11 aa, Artificial Sequence
  Description of Artificial Sequence: Synthetic peptide
  MOD_RES (5)..(5): D or E
  MOD_RES (10)..(10): R or W
STWDXSLSVXV

What is claimed is:

1. An antibody that binds to tumor tissue, wherein the antibody binds to an extracellular RNA-protein complex and wherein the antibody comprises:

a heavy chain variable region comprising:

an HCDR1 comprising a sequence GFTFSKAWMS (SEQ ID NO:1), or a variant HCDR1 in which 1 amino acid is substituted relative to the sequence;

an HCDR2 comprising a sequence RIKSVTDGETTDYAAPVKG (SEQ ID NO:9), or a variant HCDR2 in which 1 amino acid is substituted relative to the sequence; and an HCDR3 comprising a sequence TSSFCCRGGSCPSHDTSYCGGQYKSYYYMDV (SEQ ID NO:21), or a variant HCDR3 in which 1, 2, or 3 amino acids are substituted relative to the sequence;

a light chain variable region comprising:

an LCDR1 comprising a sequence SGSSSNIGSSSVS (SEQ ID NO:48), or a variant LCDR1 in which 1 amino acid is substituted relative to the sequence;

an LCDR2 comprising a sequence KNNQRPS (SEQ ID NO:59), or variant LCDR2 in which 1 amino acid is substituted relative to the sequence; and an LCDR3 comprising a sequence STWDDSLSVRV (SEQ ID NO:68), or a variant LCDR3 in which 1 amino acid is substituted relative to the sequence.

2. The antibody of claim 1, wherein the antibody comprises an HCDR1 comprising a sequence GFTFSKAWMS (SEQ ID NO:1), an HCDR2 comprising a sequence RIKSVTDGETTDYAAPVKG (SEQ ID NO:9), an HCDR3 comprising a sequence TSSFCCRGGSCPSHDTSYCGGQYKSYYYMDV (SEQ ID NO:21), an LCDR1 comprising a sequence SGSSSNIGSSSVS (SEQ ID NO:48), an LCDR2 comprising a sequence KNNQRPS (SEQ ID NO:59), and an LCDR3 comprising a sequence STWDDSLSVRV (SEQ ID NO:68).

3. The antibody of claim 2, wherein the $V_H$ comprises an amino acid sequence having at least 95% identity to EVQLVESGGALVKPGGSLRLSCAASGFTFSKAWMSWVRQAPGKGLEWVGRIKSVTDGET TDYAAPVKGRFTISRDDSKSTLYLQMNSLKTEDTAVYYCTSSFCCRGGSCPSHDTSYCGGQ YKSYYYMDVWGKGTTVTVSS (SEQ ID NO:94); and the $V_L$ comprises an amino sequence having at least 95% identity to

```
                                               (SEQ ID NO: 140)
QSVLTQPPSASGTPGQRVTISCSGSSSNIGSSSVSWYQQLPGTAPKLLIY

KNNQRPSGVPDRFSGSKSGTSASLAISGLRSEDEADYYCSTWDDSLSVRV

FGGGTKLTVL.
```

4. The antibody of claim 3, wherein the $V_H$ comprises a sequence EVQLVESGGALVKPGGSLRLSCAASGFTFSKAWMSWVRQAPGKGLEWVGRIKSVTDGET TDYAAPVKGRFTISRDDSKSTLYLQMNSLKTEDTAVYYCTSSFCCRGGSCPSHDTSYCGGQ YKSYYYMDVWGKGTTVTVSS (SEQ ID NO:94); and the $V_L$ comprises a sequence

```
                                               (SEQ ID NO: 140)
QSVLTQPPSASGTPGQRVTISCSGSSSNIGSSSVSWYQQLPGTAPKLLIY

KNNQRPSGVPDRFSGSKSGTSASLAISGLRSEDEADYYCSTWDDSLSVRV

FGGGTKLTVL.
```

5. The antibody of claim 1, wherein the antibody comprises a heavy chain constant region sequence of SEQ ID NO:1721 and a light chain constant region sequence of SEQ ID NO:1722.

6. The antibody of claim 5, wherein the heavy chain comprises a sequence of SEQ ID NO:1723 and the light chain comprises a sequence of SEQ ID NO:1724.

7. An antibody that binds to tumor tissue, wherein the antibody binds to an extracellular RNA-protein complex and wherein the antibody comprises six CDRs comprising HCDR1, HCDR2, HCDR3, LCDR1, LCDR2, LCDR3 sequences, respectively, as follows:

AIP-192482 SEQ ID NOS: 8, 9, 34, 48, 59, 68;
AIP-171142 SEQ ID NOS: 8, 9, 35, 48, 59, 68;
AIP-165430 SEQ ID NOS: 8, 9, 37, 48, 59, 68;
AIP-189526 SEQ ID NOS: 8, 16, 38, 48, 59, 68;
AIP-122563 SEQ ID NOS: 8, 9, 34, 48, 59, 68;
AIP-158623 SEQ ID NOS: 8, 9, 37, 48, 59, 68;
AIP-155066 SEQ ID NOS: 8, 9, 39, 48, 59, 68;
AIP-166120 SEQ ID NOS: 8, 9, 21, 48, 59, 68;
AIP-133645 SEQ ID NOS: 8, 9, 37, 48, 59, 73;
AIP-187893 SEQ ID NOS: 1, 9, 37, 48, 59, 68;
AIP-142079 SEQ ID NOS: 8, 9, 41, 48, 59, 68;
AIP-102396 SEQ ID NOS: 172, 366, 560, 754, 948, 1142;
AIP-150055 SEQ ID NOS: 173, 367, 561, 755, 949, 1143;
AIP-167084 SEQ ID NOS: 174, 368, 562, 756, 950, 1144;
AIP-185304 SEQ ID NOS: 175, 369, 563, 757, 951, 1145;
AIP-134770 SEQ ID NOS: 176, 370, 564, 758, 952, 1146;
AIP-141887 SEQ ID NOS: 177, 371, 565, 759, 953, 1147;
AIP-196203 SEQ ID NOS: 178, 372, 566, 760, 954, 1148;
AIP-128195 SEQ ID NOS: 180, 374, 568, 762, 956, 1150;
AIP-116579 SEQ ID NOS: 181, 375, 569, 763, 957, 1151;
AIP-192329 SEQ ID NOS: 182, 376, 570, 764, 958, 1152
AIP-197809 SEQ ID NOS: 184, 378, 572, 766, 960, 1154;
AIP-142489 SEQ ID NOS: 185, 379, 573, 767, 961, 1155;
AIP-167726 SEQ ID NOS: 187, 381, 575, 769, 963, 1157;
AIP-199834 SEQ ID NOS: 188, 382, 576, 770, 964, 1158;
AIP-143179 SEQ ID NOS: 189, 383, 577, 771, 965, 1159;
AIP-195587 SEQ ID NOS: 190, 384, 578, 772, 966, 1160;

AIP-153462 SEQ ID NOS: 191, 385, 579, 773, 967, 1161;
AIP-115363 SEQ ID NOS: 192, 386, 580, 774, 968, 1162;
AIP-151090 SEQ ID NOS: 193, 387, 581, 775, 969, 1163;
AIP-168083 SEQ ID NOS: 194, 388, 582, 776, 970, 1164;
AIP-161082 SEQ ID NOS: 195, 389, 583, 777, 971, 1165;
AIP-114196 SEQ ID NOS: 196, 390, 584, 778, 972,1166;
AIP-189338 SEQ ID NOS: 197, 391, 585, 779, 973, 1167
AIP-183190 SEQ ID NOS: 198, 392, 586, 780, 974, 1168;
AIP-110143 SEQ ID NOS: 199, 393, 587, 781, 975, 1169;
AIP-147176 SEQ ID NOS: 200, 394, 588, 782, 976, 1170;
AIP-134312 SEQ ID NOS: 201, 395, 589, 783, 977, 1171;
AIP-128243 SEQ ID NOS: 202, 396, 590, 784, 978, 1172;
AIP-156172 SEQ ID NOS: 203, 397, 591, 785, 979, 1173;
AIP-147389 SEQ ID NOS: 204, 398, 592, 786, 980, 1174;
AIP-124314 SEQ ID NOS: 205, 399, 593, 787, 981, 1175;
AIP-185291 SEQ ID NOS: 206, 400, 594, 788, 982, 1176;
AIP-135247 SEQ ID NOS: 207, 401, 595, 789, 983, 1177;
AIP-113513 SEQ ID NOS: 208, 402, 596, 790, 984, 1178;
AIP-102299 SEQ ID NOS: 209, 403, 597, 791, 985, 1179;
AIP-179097 SEQ ID NOS: 210, 404, 598, 792, 986, 1180
AIP-109343 SEQ ID NOS: 211, 405, 599, 793, 987, 1181;
AIP-119622 SEQ ID NOS: 212 ,406, 600, 794, 988, 1182;
AIP-191735 SEQ ID NOS: 213, 407, 601, 795, 989, 1183;
AIP-157078 SEQ ID NOS: 214. 408, 602, 796, 990, 1184;
AIP-153475 SEQ ID NOS: 215, 409, 603, 797, 991, 1185;
AIP-133650 SEQ ID NOS: 216, 410, 604, 798, 992, 1186;
AIP-190915 SEQ ID NOS: 217, 411, 605, 799, 993, 1187;
AIP-167400 SEQ ID NOS: 219, 413, 607, 801, 995, 1189;
AIP-109729 SEQ ID NOS: 220, 414, 608, 802, 996, 1190;
AIP-151709 SEQ ID NOS: 221, 415, 609, 803, 997, 1191;
AIP-136628 SEQ ID NOS: 226, 420, 614, 808, 1002, 1196;
AIP-101601 SEQ ID NOS: 230, 424, 618, 812, 1006, 1200;
AIP-146871 SEQ ID NOS: 232, 426, 620, 814, 1008, 1202;
AIP-170053 SEQ ID NOS: 233, 427, 621, 815, 1009, 1203;
AIP-199483 SEQ ID NOS: 234, 428, 622, 816, 1010, 1204;
AIP-162041 SEQ ID NOS: 236, 430, 624, 818, 1012, 1206;
AIP-180675 SEQ ID NOS: 1, 9, 43, 48, 59, 68;
AIP-183133 SEQ ID NOS: 238, 432, 626, 820, 1014, 1208;
AIP-191470 SEQ ID NOS: 239, 433, 627, 821, 1015, 1209;
AIP-151167 SEQ ID NOS: 240, 434, 628, 822, 1016, 1210;
AIP-106633 SEQ ID NOS: 241, 435, 629, 823, 1017, 1211;
AIP-102624 SEQ ID NOS: 242, 436, 630, 824, 1018, 1212;
AIP-109484 SEQ ID NOS: 243, 437, 631, 825, 1019, 1213;
AIP-126080 SEQ ID NOS: 1, 9, 44, 48, 59, 68;
AIP-161571 SEQ ID NOS: 1, 9, 45, 48, 59, 68;
AIP-163039 SEQ ID NOS: 251, 445, 639, 833, 1027, 1221;
AIP-101235 SEQ ID NOS: 1, 9, 20, 48, 59, 68;
AIP-182061 SEQ ID NOS: 253, 447, 641, 835, 1029, 1223;
AIP-181246 SEQ ID NOS: 1, 9, 46, 48, 59, 68;
AIP-192216 SEQ ID NOS: 1, 9, 47, 48, 59, 68;
AIP-171912 SEQ ID NOS: 255, 449, 643, 837, 1031, 1225;
AIP-172872 SEQ ID NOS: 1, 18, 21, 48, 65, 75;
AIP-167833 SEQ ID NOS: 256, 450, 644, 838, 1032, 1226;
AIP-190051 SEQ ID NOS: 8, 9, 21, 58, 59, 72;
AIP-145518 SEQ ID NOS: 257, 451, 645, 839, 1033, 1227;
AIP-167533 SEQ ID NOS: 1, 19, 21, 48, 59, 68;
AIP-112580 SEQ ID NOS: 1, 9, 27, 48, 59, 68;
AIP-143155 SEQ ID NOS: 258, 452, 646, 840, 1034, 1228;
AIP-119664 SEQ ID NOS: 259, 453, 647, 841, 1035, 1229;
AIP-190526 SEQ ID NOS: 260, 454, 648, 842, 1036, 1230;
AIP-114403 SEQ ID NOS: 261, 455, 649, 843, 1037, 1231;
AIP-156760 SEQ ID NOS: 262, 456, 650, 844, 1038, 1232;
AIP-103803 SEQ ID NOS: 263, 457, 651, 845, 1039, 1233;
AIP-195588 SEQ ID NOS: 265, 459, 653, 847, 1041, 1235;
AIP-145722 SEQ ID NOS: 266, 460, 654, 848, 1042, 1236;
AIP-178251 SEQ ID NOS: 267, 461, 655, 849, 1043, 1237;
AIP-116142 SEQ ID NOS: 268, 462, 656, 850, 1044, 1238;
AIP-183350 SEQ ID NOS: 269, 463, 657, 851, 1045, 1239;
AIP-127108 SEQ ID NOS: 270, 464, 658, 852, 1046, 1240;
AIP-128147 SEQ ID NOS: 271, 465, 659, 853, 1047, 1241;
AIP-109510 SEQ ID NOS: 272, 466, 660, 854, 1048, 1241;
AIP-104086 SEQ ID NOS: 273, 467, 661, 855, 1049, 1243;
AIP-143132 SEQ ID NOS: 274, 468, 662, 856, 1050, 1244;
AIP-170105 SEQ ID NOS: 1, 9, 21, 56, 59, 68;
AIP-169636 SEQ ID NOS: 275; 469, 663, 857, 1051, 1245;
AIP-152243 SEQ ID NOS: 276, 470, 664, 858, 1052, 1246;
AIP-138776 SEQ ID NOS: 277, 471, 665, 859, 1053, 1247;
AIP-103817 SEQ ID NOS: 278, 472, 666, 860, 1054, 1248;
AIP-130491 SEQ ID NOS: 279, 473, 667, 861, 1055, 1249;
AIP-188155 SEQ ID NOS: 280, 474, 668, 862, 1056, 1250;
AIP-167246 SEQ ID NOS: 281, 475, 669, 863, 1057, 1251;
AIP-106139 SEQ ID NOS: 282, 476, 670, 864, 1058, 1252;
AIP-198351 SEQ ID NOS: 283, 477, 671, 865, 1059, 1253;
AIP-159326 SEQ ID NOS: 284, 478, 672, 866, 1060, 1254;
AIP-192275 SEQ ID NOS: 285, 479, 673, 867, 1061, 1255;
AIP-190761 SEQ ID NOS: 286, 480, 674, 868, 1062, 1256;
AIP-166832 SEQ ID NOS: 287, 481, 675, 869, 1063, 1257;

AIP-148062 SEQ ID NOS: 288, 482, 676, 870, 1064, 1258;
AIP-129145 SEQ ID NOS: 289, 483, 677, 871, 1065, 1259;
AIP-111240 SEQ ID NOS: 290, 484, 678, 872, 1066, 1260;
AIP-153888 SEQ ID NOS: 292, 486, 680, 874, 1068, 1262;
AIP-130915 SEQ ID NOS: 293, 487, 681, 875, 1069, 1263;
AIP-109048 SEQ ID NOS: 294, 488, 682, 876, 1070, 1264;
AIP-170569 SEQ ID NOS: 295, 489, 683, 877, 1071, 1265;
AIP-154873 SEQ ID NOS: 296, 490, 684, 878, 1072, 1266;
AIP-159037 SEQ ID NOS: 297, 491, 685, 879, 1073, 1267;
AIP-186826 SEQ ID NOS: 298, 492, 686, 880, 1074, 1268;
AIP-156514 SEQ ID NOS: 299, 493, 687, 881, 1075, 1269;
AIP-157122 SEQ ID NOS: 300, 494, 688, 882, 1076, 1270;
AIP-173276 SEQ ID NOS: 301, 495, 689, 883, 1077, 1271;
AIP-150485 SEQ ID NOS: 302, 496, 690, 884, 1078, 1272;
AIP-166847 SEQ ID NOS: 304, 498, 692, 886, 1080, 1274;
AIP-124013 SEQ ID NOS: 305, 499, 693, 887, 1081, 1275;
AIP-126285 SEQ ID NOS: 306, 500, 694, 888, 1082, 1276
AIP-168605 SEQ ID NOS: 1, 9, 21, 57, 59, 74;
AIP-190274 SEQ ID NOS: 307, 501, 695, 889, 1083, 1277;
AIP-136060 SEQ ID NOS: 1, 9, 21, 48, 67, 68;
AIP-180422 SEQ ID NOS: 310, 504, 698, 892, 1086, 1280;
AIP-166722 SEQ ID NOS: 311, 505, 699, 893, 1087, 1281;
AIP-127782 SEQ ID NOS: 1, 504, 21, 48, 59, 68;
AIP-189473 SEQ ID NOS: 1, 9, 22, 48, 59, 68;
AIP-192571 SEQ ID NOS: 1, 9, 23, 48, 59, 68;
AIP-112328 SEQ ID NOS: 322, 516, 710, 904, 1098, 1292;
AIP-125258 SEQ ID NOS: 1, 9, 24, 48, 59, 68;
AIP-150199 SEQ ID NOS: 1, 9, 25, 48, 59, 68;
AIP-125062 SEQ ID NOS: 324, 518, 712, 906, 1100, 1294;
AIP-177193 SEQ ID NOS: 331, 525, 719, 913, 1107, 1301;
AIP-115388 SEQ ID NOS: 1, 9, 26, 48, 59, 68;
AIP-107759 SEQ ID NOS: 338, 532, 726, 920, 1114, 1308;
AIP-170221 SEQ ID NOS: 355, 549, 743, 937, 1131, 1325;
AIP-143369 SEQ ID NOS: 2, 10, 21, 49, 60, 68;
AIP-189475 SEQ ID NOS: 357, 551, 745, 939, 1133, 1327;
AIP-102833 SEQ ID NOS: 358, 552, 746, 940, 1134, 1328;
AIP-157045 SEQ ID NOS: 3, 11, 21, 50, 61, 69;
AIP-175775 SEQ ID NOS: 4, 9, 27, 51, 62, 70;
AIP-154181 SEQ ID NOS: 5, 12, 28, 52, 63, 71;
AIP-125984 SEQ ID NOS: 6, 13, 21, 53, 64, 76;

AIP-160829 SEQ ID NOS: 7, 14, 29, 52, 65, 69;
AIP-184744 SEQ ID NOS: 4, 15, 30, 54, 62, 71;
AIP-128136 SEQ ID NOS: 1, 12, 31, 55, 66, 72;
AIP-181273 SEQ ID NOS: 1, 9, 32, 56, 59, 72;
AIP-153125 SEQ ID NOS: 1, 12, 33, 50, 66, 68; or
AIP-131972 SEQ ID NOS: 362, 556, 750, 944, 1138, 1332;

or a variant of said antibody in which one, two, three, four, five, or all six CDR sequences contain 1 or 2 amino acid substitutions.

8. The antibody of claim 7, wherein the antibody comprises HCDR1, HCDR2, HCDR3, LCDR1, LCDR2, and LCDR3 sequences:

AIP-192482 SEQ ID NOS: 8, 9, 34, 48, 59, 68;
AIP-171142 SEQ ID NOS: 8, 9, 35, 48, 59, 68;
AIP-165430 SEQ ID NOS: 8, 9, 37, 48, 59, 68;
AIP-189526 SEQ ID NOS: 8, 16, 38, 48, 59, 68;
AIP-122563 SEQ ID NOS: 8, 9, 34, 48, 59, 68;
AIP-158623 SEQ ID NOS: 8, 9, 37, 48, 59, 68;
AIP-155066 SEQ ID NOS: 8, 9, 39, 48, 59, 68;
AIP-166120 SEQ ID NOS: 8, 9, 21, 48, 59, 68;
AIP-133645 SEQ ID NOS: 8, 9, 37, 48, 59, 73;
AIP-187893 SEQ ID NOS: 1, 9, 37, 48, 59, 68;
AIP-142079 SEQ ID NOS: 8, 9, 41, 48, 59, 68;
AIP-102396 SEQ ID NOS: 172, 366, 560, 754, 948, 1142;
AIP-150055 SEQ ID NOS: 173, 367, 561, 755, 949, 1143;
AIP-167084 SEQ ID NOS: 174, 368, 562, 756, 950, 1144;
AIP-185304 SEQ ID NOS: 175, 369, 563, 757, 951, 1145;
AIP-134770 SEQ ID NOS: 176, 370, 564, 758, 952, 1146;
AIP-141887 SEQ ID NOS: 177, 371, 565, 759, 953, 1147;
AIP-196203 SEQ ID NOS: 178, 372, 566, 760, 954, 1148;
AIP-128195 SEQ ID NOS: 180, 374, 568, 762, 956, 1150;
AIP-116579 SEQ ID NOS: 181, 375, 569, 763, 957, 1151;
AIP-192329 SEQ ID NOS: 182, 376, 570, 764, 958, 1152
AIP-197809 SEQ ID NOS: 184, 378, 572, 766, 960, 1154;
AIP-142489 SEQ ID NOS: 185, 379, 573, 767, 961, 1155;
AIP-167726 SEQ ID NOS: 187, 381, 575, 769, 963, 1157;
AIP-199834 SEQ ID NOS: 188, 382, 576, 770, 964, 1158;
AIP-143179 SEQ ID NOS: 189, 383, 577, 771, 965, 1159;
AIP-195587 SEQ ID NOS: 190, 384, 578, 772, 966, 1160;
AIP-153462 SEQ ID NOS: 191, 385, 579, 773, 967, 1161;
AIP-115363 SEQ ID NOS: 192, 386, 580, 774, 968, 1162;
AIP-151090 SEQ ID NOS: 193, 387, 581, 775, 969, 1163;
AIP-168083 SEQ ID NOS: 194, 388, 582, 776, 970, 1164;
AIP-161082 SEQ ID NOS: 195, 389, 583, 777, 971, 1165;
AIP-114196 SEQ ID NOS: 196, 390, 584, 778, 972,1166;
AIP-189338 SEQ ID NOS: 197, 391, 585, 779, 973, 1167
AIP-183190 SEQ ID NOS: 198, 392, 586, 780, 974, 1168;
AIP-110143 SEQ ID NOS: 199, 393, 587, 781, 975, 1169;
AIP-147176 SEQ ID NOS: 200, 394, 588, 782, 976, 1170;
AIP-134312 SEQ ID NOS: 201, 395, 589, 783, 977, 1171;
AIP-128243 SEQ ID NOS: 202, 396, 590, 784, 978, 1172;
AIP-156172 SEQ ID NOS: 203, 397, 591, 785, 979, 1173;
AIP-147389 SEQ ID NOS: 204, 398, 592, 786, 980, 1174;
AIP-124314 SEQ ID NOS: 205, 399, 593, 787, 981, 1175;
AIP-185291 SEQ ID NOS: 206, 400, 594, 788, 982, 1176;
AIP-135247 SEQ ID NOS: 207, 401, 595, 789, 983, 1177;
AIP-113513 SEQ ID NOS: 208, 402, 596, 790, 984, 1178;
AIP-102299 SEQ ID NOS: 209, 403, 597, 791, 985, 1179;
AIP-179097 SEQ ID NOS: 210, 404, 598, 792, 986, 1180
AIP-109343 SEQ ID NOS: 211, 405, 599, 793, 987, 1181;
AIP-119622 SEQ ID NOS: 212 ,406, 600, 794, 988, 1182;
AIP-191735 SEQ ID NOS: 213, 407, 601, 795, 989, 1183;
AIP-157078 SEQ ID NOS: 214, 408, 602, 796, 990, 1184;
AIP-153475 SEQ ID NOS: 215, 409, 603, 797, 991, 1185;
AIP-133650 SEQ ID NOS: 216, 410, 604, 798, 992, 1186;
AIP-190915 SEQ ID NOS: 217, 411, 605, 799, 993, 1187;

AIP-167400 SEQ ID NOS: 219, 413, 607, 801, 995, 1189;
AIP-109729 SEQ ID NOS: 220, 414, 608, 802, 996, 1190;
AIP-151709 SEQ ID NOS: 221, 415, 609, 803, 997, 1191;
AIP-136628 SEQ ID NOS: 226, 420, 614, 808, 1002, 1196;
AIP-101601 SEQ ID NOS: 230, 424, 618, 812, 1006, 1200;
AIP-146871 SEQ ID NOS: 232, 426, 620, 814, 1008, 1202;
AIP-170053 SEQ ID NOS: 233, 427, 621, 815, 1009, 1203;
AIP-199483 SEQ ID NOS: 234, 428, 622, 816, 1010, 1204;
AIP-162041 SEQ ID NOS: 236, 430, 624, 818, 1012, 1206;
AIP-180675 SEQ ID NOS: 1, 9, 43, 48, 59, 68;
AIP-183133 SEQ ID NOS: 238, 432, 626, 820, 1014, 1208;
AIP-191470 SEQ ID NOS: 239, 433, 627, 821, 1015, 1209;
AIP-151167 SEQ ID NOS: 240, 434, 628, 822, 1016, 1210;
AIP-106633 SEQ ID NOS: 241, 435, 629, 823, 1017, 1211;
AIP-102624 SEQ ID NOS: 242, 436, 630, 824, 1018, 1212;
AIP-109484 SEQ ID NOS: 243, 437, 631, 825, 1019, 1213;
AIP-126080 SEQ ID NOS: 1, 9, 44, 48, 59, 68;
AIP-161571 SEQ ID NOS: 1, 9, 45, 48, 59, 68;
AIP-163039 SEQ ID NOS: 251, 445, 639, 833, 1027, 1221;
AIP-101235 SEQ ID NOS: 1, 9, 20, 48, 59, 68;
AIP-182061 SEQ ID NOS: 253, 447, 641, 835, 1029, 1223;
AIP-181246 SEQ ID NOS: 1, 9, 46, 48, 59, 68;
AIP-192216 SEQ ID NOS: 1, 9, 47, 48, 59, 68;
AIP-171912 SEQ ID NOS: 255, 449, 643, 837, 1031, 1225;
AIP-172872 SEQ ID NOS: 1, 18, 21, 48, 65, 75;
AIP-167833 SEQ ID NOS: 256, 450, 644, 838, 1032, 1226;
AIP-190051 SEQ ID NOS: 8, 9, 21, 58, 59, 72;
AIP-145518 SEQ ID NOS: 257, 451, 645, 839, 1033, 1227;
AIP-167533 SEQ ID NOS: 1, 19, 21, 48, 59, 68;
AIP-112580 SEQ ID NOS: 1, 9, 27, 48, 59, 68;
AIP-143155 SEQ ID NOS: 258, 452, 646, 840, 1034, 1228;
AIP-119664 SEQ ID NOS: 259, 453, 647, 841, 1035, 1229;
AIP-190526 SEQ ID NOS: 260, 454, 648, 842, 1036, 1230;
AIP-114403 SEQ ID NOS: 261, 455, 649, 843, 1037, 1231;
AIP-156760 SEQ ID NOS: 262, 456, 650, 844, 1038, 1232;
AIP-103803 SEQ ID NOS: 263, 457, 651, 845, 1039, 1233;
AIP-195588 SEQ ID NOS: 265, 459, 653, 847, 1041, 1235;
AIP-145722 SEQ ID NOS: 266, 460, 654, 848, 1042, 1236;
AIP-178251 SEQ ID NOS: 267, 461, 655, 849, 1043, 1237;
AIP-116142 SEQ ID NOS: 268, 462, 656, 850, 1044, 1238;
AIP-183350 SEQ ID NOS: 269, 463, 657, 851, 1045, 1239;
AIP-127108 SEQ ID NOS: 270, 464, 658, 852, 1046, 1240;
AIP-128147 SEQ ID NOS: 271, 465, 659, 853, 1047, 1241;
AIP-109510 SEQ ID NOS: 272, 466, 660, 854, 1048, 1241;
AIP-104086 SEQ ID NOS: 273, 467, 661, 855, 1049, 1243;
AIP-143132 SEQ ID NOS: 274, 468, 662, 856, 1050, 1244;
AIP-170105 SEQ ID NOS: 1, 9, 21, 56, 59, 68;
AIP-169636 SEQ ID NOS: 275; 469, 663, 857, 1051, 1245;
AIP-152243 SEQ ID NOS: 276, 470, 664, 858, 1052, 1246;
AIP-138776 SEQ ID NOS: 277, 471, 665, 859, 1053, 1247;
AIP-103817 SEQ ID NOS: 278, 472, 666, 860, 1054, 1248;
AIP-130491 SEQ ID NOS: 279, 473, 667, 861, 1055, 1249;
AIP-188155 SEQ ID NOS: 280, 474, 668, 862, 1056, 1250;
AIP-167246 SEQ ID NOS: 281, 475, 669, 863, 1057, 1251;
AIP-106139 SEQ ID NOS: 282, 476, 670, 864, 1058, 1252;
AIP-198351 SEQ ID NOS: 283, 477, 671, 865, 1059, 1253;
AIP-159326 SEQ ID NOS: 284, 478, 672, 866, 1060, 1254;
AIP-192275 SEQ ID NOS: 285, 479, 673, 867, 1061, 1255;
AIP-190761 SEQ ID NOS: 286, 480, 674, 868, 1062, 1256;
AIP-166832 SEQ ID NOS: 287, 481, 675, 869, 1063, 1257;
AIP-148062 SEQ ID NOS: 288, 482, 676, 870, 1064, 1258;
AIP-129145 SEQ ID NOS: 289, 483, 677, 871, 1065, 1259;
AIP-111240 SEQ ID NOS: 290, 484, 678, 872, 1066, 1260;
AIP-153888 SEQ ID NOS: 292, 486, 680, 874, 1068, 1262;
AIP-130915 SEQ ID NOS: 293, 487, 681, 875, 1069, 1263;
AIP-109048 SEQ ID NOS: 294, 488, 682, 876, 1070, 1264;
AIP-170569 SEQ ID NOS: 295, 489, 683, 877, 1071, 1265;
AIP-154873 SEQ ID NOS: 296, 490, 684, 878, 1072, 1266;
AIP-159037 SEQ ID NOS: 297, 491, 685, 879, 1073, 1267;
AIP-186826 SEQ ID NOS: 298, 492, 686, 880, 1074, 1268;
AIP-156514 SEQ ID NOS: 299, 493, 687, 881, 1075, 1269;
AIP-157122 SEQ ID NOS: 300, 494, 688, 882, 1076, 1270;
AIP-173276 SEQ ID NOS: 301, 495, 689, 883, 1077, 1271;
AIP-150485 SEQ ID NOS: 302, 496, 690, 884, 1078, 1272;

AIP-166847 SEQ ID NOS: 304, 498, 692, 886, 1080, 1274;
AIP-124013 SEQ ID NOS: 305, 499, 693, 887, 1081, 1275;
AIP-126285 SEQ ID NOS: 306, 500, 694, 888, 1082, 1276
AIP-168605 SEQ ID NOS: 1, 9, 21, 57, 59, 74;
AIP-190274 SEQ ID NOS: 307, 501, 695, 889, 1083, 1277;
AIP-136060 SEQ ID NOS: 1, 9, 21, 48, 67, 68;
AIP-180422 SEQ ID NOS: 310, 504, 698, 892, 1086, 1280;
AIP-166722 SEQ ID NOS: 311, 505, 699, 893, 1087, 1281;
AIP-127782 SEQ ID NOS: 1, 504, 21, 48, 59, 68;
AIP-189473 SEQ ID NOS: 1, 9, 22, 48, 59, 68;
AIP-192571 SEQ ID NOS: 1, 9, 23, 48, 59, 68;
AIP-112328 SEQ ID NOS: 322, 516, 710, 904, 1098, 1292;
AIP-125258 SEQ ID NOS: 1, 9, 24, 48, 59, 68;
AIP-150199 SEQ ID NOS: 1, 9, 25, 48, 59, 68;
AIP-125062 SEQ ID NOS: 324, 518, 712, 906, 1100, 1294;
AIP-177193 SEQ ID NOS: 331, 525, 719, 913, 1107, 1301;
AIP-115388 SEQ ID NOS: 1, 9, 26, 48, 59, 68;
AIP-107759 SEQ ID NOS: 338, 532, 726, 920, 1114, 1308;
AIP-170221 SEQ ID NOS: 355, 549, 743, 937, 1131, 1325;
AIP-143369 SEQ ID NOS: 2, 10, 21, 49, 60, 68;
AIP-189475 SEQ ID NOS: 357, 551, 745, 939, 1133, 1327;
AIP-102833 SEQ ID NOS: 358, 552, 746, 940, 1134, 1328;
AIP-157045 SEQ ID NOS: 3, 11, 21, 50, 61, 69;
AIP-175775 SEQ ID NOS: 4, 9, 27, 51, 62, 70;
AIP-154181 SEQ ID NOS: 5, 12, 28, 52, 63, 71;
AIP-125984 SEQ ID NOS: 6, 13, 21, 53, 64, 76;
AIP-160829 SEQ ID NOS: 7, 14, 29, 52, 65, 69;
AIP-184744 SEQ ID NOS: 4, 15, 30, 54, 62, 71;
AIP-128136 SEQ ID NOS: 1, 12, 31, 55, 66, 72;
AIP-181273 SEQ ID NOS: 1, 9, 32, 56, 59, 72;
AIP-153125 SEQ ID NOS: 1, 12, 33, 50, 66, 68; or
AIP-131972 SEQ ID NOS: 362, 556, 750, 944, 1138, 1332.

9. An expression vector comprising a polynucleotide encoding the $V_H$ region of the antibody of claim 1.

10. An expression vector comprising a polynucleotide encoding the $V_L$ region of the antibody of claim 1.

11. An expression vector comprising a polynucleotide encoding the $V_H$ region and the $V_L$ region of the antibody of claim 1.

12. A host cell comprising a polynucleotide that encodes the $V_H$ region of the antibody of claim 1.

13. A host cell comprising a polynucleotide that encodes the $V_L$ region of the antibody of claim 1.

14. A host cell comprising a polynucleotide that encodes the $V_H$ region and the $V_L$ region of the antibody of claim 1.

15. A method of producing an antibody, the method comprising culturing a host cell of claim 14 under conditions in which the polynucleotide encoding the heavy chain and the polynucleotide encoding the light chain are expressed.

16. An antibody that binds to tumor tissue, wherein the antibody binds to an extracellular RNA-protein complex and wherein the antibody comprises:

(a) a heavy chain variable region comprising:

(i) an HCDR1 having the sequence GF(T/V)(F/Y)(S/A)$X_6$AWM(S/T) (SEQ ID NO:1728), wherein $X_6$ is K, A, or M;

(ii) an HCDR2 having the sequence of RIK(S/A)$X_5X_6$(D/E)(G/A)$X_9X_{10}$T(D/E)YAA(P/S)VKG (SEQ ID NO:1729), wherein $X_5$ is V, N, A, or T; $X_6$ is T, Q, S, D, or H; $X_9$ is E, H, K, or G; and $X_{10}$ is T, Q, or I; and (iii) an HCDR3 having the sequence of (I/T)(S/T)SFCC(H/R)(G/S)$X_9X_{10}$CPS$X_{14}$(D/E)TS(F/Y)C$X_{20}$(G/N)$X_{22}X_{23}X_{24}X_{25}$ (F/Y)Y(F/Y)(M/V)(D/N)$X_{31}$ (SEQ ID NO:1730), wherein $X_9$ is A, G, K, or N; $X_{10}$ is N, Q, R, or S; $X_{14}$ is H, R, or S; $X_{20}$ is A, G, or N; $X_{22}$ is Q, S, or Y; $X_{23}$ is D, F, N, or Y; $X_{24}$ is A, K, N, P, or S; $X_{25}$ is D, Q, R, or S; and $X_{31}$ is I, P, or V; and (b) a light chain variable region comprising:

(i) an LCDR1 having the sequence of SG(S/A)$X_4$(S/T)(N/D)IGSS$X_{11}$V$X_{13}$ (SEQ ID NO:1731), wherein $X_4$ is S, P, or K; $X_{11}$ is S, Y, or T; and $X_{13}$ is S, Y, or T;

(ii) an LCDR2 having the sequence of (K/M)(N/D)$X_3X_4$R(P/A)$X_7$ (SEQ ID NO:1732), wherein $X_3$ is S, N or T; $X_4$ is L, Q, or A; $X_7$ is Q, S, Y, or L; and (iii) an LCDR3 having the sequence of (S/A)(T/S)W(D/N)$X_5X_6$(L/N)$X_8$(V/I)R(V/I) (SEQ ID NO:1733), wherein $X_5$ is E, D or N; $X_6$ is S, A, or Q; and $X_8$ is N, S or T.

17. The antibody of claim 16 wherein:

the HCDR1 has a sequence GFTFSKAWMS (SEQ ID NO:1), GFTFSAAWMS (SEQ ID NO:4), or GFTFSKAWMT (SEQ ID NO:8);

the HCDR2 has a sequence RIKSVTDGETTDYAAPVKG (SEQ ID NO:9) or RIKSTSDGETTDYAAPVKG (SEQ ID NO:15);

the HCDR3 has a sequence TSSFCCRGGSCPSSDTSYCGGQYKSYYFMDV (SEQ ID NO:32), TSSFCCRSGSCPSSDTSYCNGQYKSYYYMDV (SEQ ID NO:20), TSSFCCRGNQCPSSDTSYCGGQYPSYYYMDP (SEQ ID NO:23), ISSFCCRGGSCPSRDTSYCGGQYKSYYFMDV (SEQ ID NO:30), ISSFCCRGNSCPSSDTSYCNGQYKSYYYMDV (SEQ ID NO:27), TSSFCCRGGSCPSHDTSYCGGQYKSYYYMDV (SEQ ID NO:21), or TSSFCCRGGSCPSHDTSFCGGQDKRYYYMDV (SEQ ID NO:34);

the LCDR1 has a sequence SGSSSNIGSSSVY (SEQ ID NO:56), SGSSSNIGSSSVS (SEQ ID NO:48), SGSSTNIGSSSVS (SEQ ID NO:54), or SGSKSNIGSSSVS (SEQ ID NO:51);

the LCDR2 has a sequence KNNQRPS (SEQ ID NO:59) or KDNQRPS (SEQ ID NO:62); and the LCDR3 has a sequence STWDDALSVRV (SEQ ID NO:72), STWDDSLSVRV (SEQ ID NO:68), SSWDDSNSVRI (SEQ ID NO:71), or ATWDNSLSIRV (SEQ ID NO:70).

18. The antibody of claim 17, wherein the heavy chain variable region has a sequence having at least 90% identity to the sequence of any one of (SEQ ID NO: 92)
EVQLVESGGALVKPGGSLRLSCAASGFTFSKAWMSWVRQAPGKGLEWVGR

IKSVTDGETTDYAAPVKGRFTISRDDSKSTLYLQMNSLKTEDTAVYYCTS

SFCCRGGSCPSSDTSYCGGQYKSYYFMDVWGKGTTVTVSS, (SEQ ID NO: 77)
EVQLVESGGALVKPGGSLRLSCAASGFTFSKAWMSWVRQAPGKGLEWVGR

IKSVTDGETTDYAAPVKGRFTISRDDSKSTLYLQMNSLKTEDTAVYYCTS

SFCCRSGSCPSSDTSYCNGQYKSYYYMDVWGKGTTVTVSS, (SEQ ID NO: 80)
EVQLVESGGALVKPGGSLRLSCAASGFTFSKAWMSWVRQAPGKGLEWVGR

IKSVTDGETTDYAAPVKGRFTISRDDSKSTLYLQMNSLKTEDTAVYYCTS

SFCCRGNQCPSSDTSYCGGQYPSYYYMDPWGKGTTVTVSS, (SEQ ID NO: 90)
EVQLVESGGALVKPGGSLRLSCAASGFTFSAAWMSWVRQAPGKGLEWVGR

IKSTSDGETTDYAAPVKGRFTISRDDSKSTLYLQMNSLKTEDTAVYYCIS

SFCCRGGSCPSRDTSYCGGQYKSYYFMDVWGKGTTVTVSS, (SEQ ID NO: 86)
EVQLVESGGALVKPGGSLRLSCAASGFTFSAAWMSWVRQAPGKGLEWVGR

IKSVTDGETTDYAAPVKGRFTISRDDSKSTLYLQMNSLKTEDTAVYYCIS

SFCCRGNSCPSSDTSYCNGQYKSYYYMDVWGKGTTVTVSS, (SEQ ID NO: 94)
EVQLVESGGALVKPGGSLRLSCAASGFTFSKAWMSWVRQAPGKGLEWVGR

IKSVTDGETTDYAAPVKGRFTISRDDSKSTLYLQMNSLKTEDTAVYYCTS

SFCCRGGSCPSHDTSYCGGQYKSYYYMDVWGKGTTVTVSS,
and (SEQ ID NO: 95)
EVQLVESGGALVKPGGSLRLSCAASGFTFSKAWMTWVRQAPGKGLEWVGR

IKSVTDGETTDYAAPVKGRFTISRDDSKSVLYLQMSSLKTEDTAVYFCTS

SFCCRGGSCPSHDTSFCGGQDKRYYYMDVWGKGTTVTVSS.

19. The antibody of claim 17, wherein the light chain variable region has a sequence having at least 90% identity to the sequence of any one of (SEQ ID NO: 138)
QSVLTQPPSASGTPGQRVTISCSGSSSNIGSSSVYWYQQLPGTAPKWYKN

NQRPSGVPDRFSGSKSGTSASLAISGLRSEDEADYYCSTWDDALSVRVFG

GGTKLTVL, (SEQ ID NO: 140)
QSVLTQPPSASGTPGQRVTISCSGSSSNIGSSSVSWYQQLPGTAPKLLIY

KNNQRPSGVPD, (SEQ ID NO: 136)
RFSGSKSGTSASLAISGLRSEDEADYYCSTWDDSLSVRVFGGGTKLTVL,

QSVLTQPPSASGTPGQRVTISCSGSSTNIGSSSVSWYQQLPGTAPKLLIY

KDNQRPSGVPDRFSGSKSGTSASLAISGLRSEDEADYYCSSWDDSNSVRI

FGGGTKLTVL,

-continued (SEQ ID NO: 132)
QSVLTQPPSASGTPGQRVTISCSGSKSNIGSSSVSWYQQLPGTAPKLLIY

KDNQRPSGVPDRFSGSKSGTSASLAISGLRSEDEADYYCATWDNSLSIRV

FGGGTKLTVL,
and (SEQ ID NO: 141)
QSVLTQAPSASETPGQRVIISCSGSSSNIGSSSVSWYQQLPGTAPKLLIY

KNNQRPSGVPDRFSGSKSGTSASLAISGLRSEDEADYYCSTWDDSLSVRV

FGGGTKLTVL.

20. The antibody of claim 17, wherein:
the HCDR1 has a sequence GFTFSKAWMS (SEQ ID NO:1);
the HCDR2 has a sequence RIKSVTDGETTDYAAPVKG (SEQ ID NO:9);
the HCDR3 has a sequence TSSFCCRGGSCPSSDTSYCGGQYKSYYFMDV (SEQ ID NO:32);
the LCDR1 has a sequence SGSSSNIGSSSVY (SEQ ID NO:56);
the LCDR2 has a sequence KNNQRPS (SEQ ID NO:59); and
the LCDR3 has a sequence STWDDALSVRV (SEQ ID NO:72).

21. The antibody of claim 17, wherein:
the HCDR1 has a sequence GFTFSKAWMS (SEQ ID NO:1);
the HCDR2 has a sequence RIKSVTDGETTDYAAPVKG (SEQ ID NO:9);
the HCDR3 has a sequence of TSSFCCRSGSCPSSDTSYCNGQYKSYYYMDV (SEQ ID NO:20);
the LCDR1 has a sequence SGSSSNIGSSSVS (SEQ ID NO:48);
the LCDR2 has a sequence KNNQRPS (SEQ ID NO:59); and
the LCDR3 has a sequence STWDDSLSVRV (SEQ ID NO:68).

22. The antibody of claim 17, wherein:
the HCDR1 has a sequence GFTFSKAWMS (SEQ ID NO:1);
the HCDR2 has a sequence RIKSVTDGETTDYAAPVKG (SEQ ID NO:9);
the HCDR3 has a sequence TSSFCCRGNQCPSSDTSYCGGQYPSYYYMDP (SEQ ID NO:23);
the LCDR1 has a sequence SGSSSNIGSSSVS (SEQ ID NO:48);
the LCDR2 has a sequence KNNQRPS (SEQ ID NO:59); and
the LCDR3 has a sequence STWDDSLSVRV (SEQ ID NO:68).

23. The antibody of claim 17, wherein:
the HCDR1 has a sequence GFTFSAAWMS (SEQ ID NO:4);
the HCDR2 has a sequence RIKSTSDGETTDYAAPVKG (SEQ ID NO:15);
the HCDR3 has a sequence ISSFCCRGGSCPSRDTSYCGGQYKSYYFMDV (SEQ ID NO:30);
the LCDR1 has a sequence SGSSTNIGSSSVS (SEQ ID NO:54);
the LCDR2 has a sequence KDNQRPS (SEQ ID NO:62); and the LCDR3 has a sequence SSWDDSNSVRI (SEQ ID NO:71).

24. The antibody of claim 17, wherein:

the HCDR1 has a sequence GFTFSAAWMS (SEQ ID NO:4);

the HCDR2 has a sequence RIKSVTDGETTDYAAPVKG (SEQ ID NO:9);

the HCDR3 has a sequence ISSFCCRGNSCPSSDTSYCNGQYKSYYYMDV (SEQ ID NO:27);

the LCDR1 has a sequence SGSKSNIGSSSVS (SEQ ID NO:51);

the LCDR2 has a sequence KDNQRPS (SEQ ID NO:62); and the LCDR3 has a sequence ATWDNSLSIRV (SEQ ID NO:70).

25. The antibody of claim 17, wherein:

the HCDR1 has a sequence GFTFSKAWMT (SEQ ID NO:8);

the HCDR2 has a sequence RIKSVTDGETTDYAAPVKG (SEQ ID NO:9);

the HCDR3 has a sequence TSSFCCRGGSCPSHDTSFCGGQDKRYYYMDV (SEQ ID NO:34);

the LCDR1 has a sequence SGSSSNIGSSSVS (SEQ ID NO:48);

the LCDR2 has a sequence KNNQRPS (SEQ ID NO:59); and the LCDR3 has a sequence STWDDSLSVRV (SEQ ID NO:68).

26. An expression vector comprising a polynucleotide encoding the $V_H$ region or the $V_L$ region of the antibody of claim 16.

27. An expression vector comprising a polynucleotide encoding the $V_H$ region and the $V_L$ region of the antibody of claim 16.

28. A host cell comprising a polynucleotide that encodes the $V_H$ region or the $V_L$ region of the antibody of claim 16.

29. A host cell comprising a polynucleotide that encodes the $V_H$ region and the $V_L$ region of the antibody of claim 16.

30. A method of producing an antibody, the method comprising a host cell of claim 29 under conditions in which the polynucleotide encoding the heavy chain and the polynucleotide encoding the light chain are expressed.

31. An expression vector comprising a polynucleotide encoding the $V_H$ region or the $V_L$ region of the antibody of claim 7.

32. An expression vector comprising a polynucleotide encoding the $V_H$ region and the $V_L$ region of the antibody of claim 7.

33. A host cell comprising a polynucleotide that encodes the $V_H$ region or the $V_L$ region of the antibody of claim 7.

34. A host cell comprising a polynucleotide that encodes the $V_H$ region and the $V_L$ region of the antibody of claim 7.

35. A method of producing an antibody, the method comprising a host cell of claim 34 under conditions in which the polynucleotide encoding the heavy chain and the polynucleotide encoding the light chain are expressed.

36. A polypeptide comprising a $V_H$ sequence EVQLVESGGALVKPGGSLRLSCAASGFTFSKAWMSWVRQAPGKGLEWVGRIKSVTDGETTDYAAPVKGRFTISRDDSKSTLYLQMNSLKTEDTAVYYCTSSFCCRGGSCPSHDTSYCGGQYKSYYYMDVWGKGTTVTVSS (SEQ ID NO:94); and a $V_L$ sequence

```
                                          (SEQ ID NO: 140)
QSVLTQPPSASGTPGQRVTISCSGSSSNIGSSSVSWYQQLPGTAPKLLIY

KNNQRPSGVPDRFSGSKSGTSASLAISGLRSEDEADYYCSTWDDSLSVRV

FGGGTKLTVL.
```

* * * * *

UNITED STATES PATENT AND TRADEMARK OFFICE

CERTIFICATE OF CORRECTION

PATENT NO. : 11,472,885 B2
APPLICATION NO. : 16/792115
DATED : October 18, 2022
INVENTOR(S) : Defalco et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 159 days.

Signed and Sealed this
Eleventh Day of February, 2025

Coke Morgan Stewart
*Acting Director of the United States Patent and Trademark Office*